United States Patent 9,567,581 (SELECTIVE REACTIVATION OF GENES ON THE INACTIVE X CHROMOSOME) - sequence listing, part 17

SEQ ID NO: 1348 - DNA, 84672 bp, mus musculus
gagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaat

SEQ ID NO: 1349 - DNA, 84672 bp, mus musculus; identical to SEQ ID NO: 1348

SEQ ID NO: 1350 - DNA, 60769 bp, mus musculus
ccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttg

SEQ ID NO: 1351 - DNA, 2044 bp, mus musculus; identical to SEQ ID NO: 223

SEQ ID NO: 1352 - DNA, 21541 bp, mus musculus; identical to SEQ ID NO: 224

SEQ ID NO: 1353 - DNA, 21541 bp, mus musculus; identical to SEQ ID NO: 224

SEQ ID NO: 1354 - DNA, 21465 bp, mus musculus; identical to SEQ ID NO: 226

SEQ ID NO: 1355 - DNA, 2388 bp, mus musculus
aggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccatgttggccgggctggtcttgaactcctgagctcaagtggtccactcgtcttggcctcccaaagtgctgggattacaggcgtgagccaccgcgcccggccttcttttttagaggcagagtctcagactggagggcagtgatgtggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccacggtgcctggcctttagtcatggtcttaaaacagaatgtaggccgggcgcagtggctcacgcctgtaatcccagcactttgggaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaa

SEQ ID NO: 1356 - DNA, 2388 bp, mus musculus; identical to SEQ ID NO: 1355

SEQ ID NO: 1357 - DNA, 11820 bp, mus musculus
cgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatatt

SEQ ID NO: 1358 - DNA, 11820 bp, mus musculus; identical to SEQ ID NO: 1357

SEQ ID NO: 1359 - DNA, 1563 bp, mus musculus
ccggccctgcacggcgcgtaccctgggggttcgggcggggaagcggcgccggcccggaccccccgcgggagtaggcgacgggcgtgagggcgaggcggcggcggcggcggccagagagcagcagccgcctggtgagtgtccgcggggaggcccggcacctgcccgagcagggacgtcgggggcgcccccgggatcgtcccagtgaccctgtgcctgagacggtgggcgtgtgcgcaactgcggcgtcccggggactcaccccggcccgggactgcggctgacagcgggaactgcggggctgccggaggtttgcgcagggcctggcgcgtccgcgcccgccccagacgccccgagaggccgaggggagagggagtggctggggtggggtgtcgacttgattggccttggtcccccaaacggaggggacgatgcccttcctcgccggaccctaggcattgcggagagtgagcctctgtggaccggctttaagcccccaggaaggtgtttgaggatgaggactagcagcaccagcgtgggggccgttgagggtgttgagagatgtgaaggttagtagcagtatagtaagaattgttggagaggaggtttccagatgactgttggtaggtgttgagtaaggagaaaacactgctttcctttaaagatcgcacaagcagtcctctgaggtccaacaacagattagagttattcccagttggagttctgtagtttactaccgtgtgccagctcataaagtgcgtaaaagcaggatttgaagggtgagggacaggtgaggcataaagtaagctgcataaaaagatccaaagtttgttaatgtgttaaagtgtaaatccttctgtttctactgaaatgtaacttatttaaattatttaagaaaacttgccacctttggtccagaccgggcttgtcagttcgatgtgtttcttcagtgacgtttgtcaatcaggcagtcattttggcatacagtatatttacttctggtttctaaaagaacaagaatgaatgagaaaagggaacagtttggcaaactgagctttctttgcgcactttttcattttgaaaggataagagaatttacttttttctttgctttagtaatgatttgcagtagtatacaagaacacgtggaagaagaaagggttttttgagatgagagtttaattttgcacagtgttaaattataaagggcctcatcacccatggtaagttttgtgatggtgtgttttatgaacaccggaagaatacaggcacatacatatacatgctttttagtcagtgtgtgatatgaatctttacaaccgtagggacagcccccgcccccacttgcttacaactggcttaatcaagggaaagacttcagtgaaggtaaatattaaatatgtgattttcatcttcacatctgaaagaacataatctgcattcagtcaccctgaattttcatccatatgtttatttgatggagtcttcccctcagttatagataccacattgtgtacagtttgttggagcaaacagagctaacgtcgattatattcaggcactgga

SEQ ID NO: 1360 - DNA, 8695 bp, mus musculus
gagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtg

SEQ ID NO: 1361 - DNA, 6705 bp, mus musculus
agggaaaggccctaggccataaacgggggtggggcctccccggaggccagtgcgcggccgcggtgctctaccggcgtgtcgctccgccccagggagagccggcgctaccatggaggagtaccatcgccactgcgacgaggtaccgccccttggctacctgggagcgccccccactcccgccttcctctgcgcggggctcttgccgggtggtctcccagcgagggcggtcccaagagttggggtgcggcgtcctccgagcccgggtcctctcccctgggcccgggatccgccccgcccgacccgttctccccaccccaaagtcctgagattcggggtgggaggggtggccaggagcgcgcggatcagacggtggggtcggggcagggttgggaggacgaggcctgacttgggtgcgaggagtgggcatggggtgacgggcgccgccctcctaccgggcgggcctcgaaaacgggtcttcccgctgctgcctccgtcccttggcttcctcagcgcgggtgctgcagcccccatggctcggagtctcggggtcctggtggcactgccattcccgctcccggtaatgcttgccaggattaggcaaggaggtgctttatggattacgagcccttgcttactgactcaggctttcccaaccctcaccagaaacccatgatgtcagttgttatctccctgttattgatggggactccaaagaaaagactaagttgtcagaccactttatagtactaaagtgatattaatcttgagttatcaagtattttcataatctttaatttgggaaaggaatttttgcctagaaatttttgcctagcataagttaaaaacaaaattgaaaatagtctactaagcattctcttcatatggaccacttcattctctcacttagctgaaaccatttctatattcttatgacacataacatcctcatagtcacctcttgcttatttcctacgttttacaatacaatgattcttaatctaggatgttcattagaatcaccagtataaagcacttttttaaaaaaaaatgtagacttgcaggctctgccccagacctcacgggaggtaggtagggaaagcattcagtatttttaagtgtttaggggcaagattggccccttctgtagacctgatgccctttaacactttaacacctgtctaggccagcctaggatattctgtgtagcgtcatacttgtaagcctgtgttgaaagcagctttaccttttgttttccctttaggttggcttcaatgctgaggaagcccacaatattgtcaaagaggtgagtcatacattttgtttctcttgaagcttgctgcactggtggagatttttaaaagctatattttgagtttcagcacaaacttagaaaccttactgttaaaagaagaatattttgttttgttttattttattttattgttttttgagatggagtctcgctctgtcacccatgctggagaacagtggtgtgatctcagctcactgcaacctccacctcctgggttcaagcaattctcctgtctcagcctcccgagtagctgggtctacaggcgcccgccaccacacccatccaatttttgtatttttagtagagacggggtttcaccttattggtcaggctggtttcgaattcctgacctccggtgatccacccgccttggcctcccaaagtgctgggattgcaggcgtgaaccaccacacccggccaagaacaagattttaaatatttatccactaactctttataggggtccttctatattttgttgtgtgctatcagcatcttgaggcttattctgaaagagatgcttaaggattttcttagtctagaaaactggtttaaaattgatgccctgtcttttggataaaataacttttattccagaaagcaaacattattttaaatgttaatgctataaagtatatgtacgcatatatatgtacacacgtcaacttttataatgtaaagtatatgtataatatatatgtatattgtataaaatagataacaaaagccctagaaatatctgcctttgggcatgtacacttttttgcccaatataattggaaaaaatgatcatttaacatattttaagcattgatatgatagtgaatcaaaattttaagaaaaatatttgaaactccttttaggcaaatagaaaagaaattacctttgggaattaattctggcaggggaccgttcattattttagaggtatcacatacagaccacagtgtgggaaaggtattttttgacacccaggtctggccttacacagctagaattaactcaaggtctgagaggaatagacaggcacctgaaaatcctgccatatttgaatacttcagaattatgcattctatctatgtagcctgagagtatttaattattaaaagtagaaagcaaaggtttttaatacctttacaatgtaaaagcacaaatgagggaaactgggaggtggaagagggagtggaggtaatgagaagggagtgatcttagttttcaaagtggcaagtcaggaaagactgtccttggttgatggaacataaaagaaagaatgctgggctatttgggattccatttaaatagtgccttcttccttaagttctgaaccaaatgaaaagaaaaaagagccattagaaagagaacaaaataccacctttattattgataaaaaccagtttgatgattgtaccttgttttgctaactcccattcagttcagccctgggaagagtcatccaagagaaagtttgagtcagcagagagaaacacttgttcaggctggtgcctttcattggtttgggtggagagggaaggagaaactaaagcccaagttcaacacatttgggagactcccaaatgagatgttagaacaatggttatcacccaccaaccaggtaactcattccacctccatggggaggaataactgacaggacaagaggccaggaatgttaaagaacaatcctctgcgttgaagaaaacatccagagtggaaaagaaacatgtttctaacagtgtaaatatatttaagttaaaaaatcgtgatttcactatattgagagaagggggcgggtggtctgagggaaccaaattttcatctatcatagtaggagttacatggatgttgcctataattcataaatcaggaaatagtgagataaacattatttggagatacataagtaacccttggaagaaataaaaacagttgtacactgatgagtttcctctggggaatgggactggggatgggaaaggaaagggtgggaaggaaactcttcattctaagcttttctgttctactggatttttcaaaccatatgcctgttactttaatattatatcaaattaaaagaatcatgctttttcaactgggaaatacatactcggcagtggctaggtggtgctagaagtcactggatgcattttagaacatcagtttttcttgaatatttgtgagagggagttaagtaatataaataatataactgaaaacatttttgaataaaaacaaactctgatgcattatgtagtcaaaacaagcttctcttgaatttttatatgaaatatgagactgcaaagaaactcagctttgctacaggttacttgcagctaaatgtctatctttcctcttcccatgaaccaaccctcttctgccattgaaacatttccattgagacattggaaatgcctgagaatgagcaacattttaaaacagtttagcacttcctagatgattacataatttcagcagttatttctgatttccttactgatcttattttcttattgatcttattttctttcctttgatttcttgctctgagcccctatgctaatatgtttttccttctgaactcagagacacccatttatcagtaatatgcatacattttctttagtgttagtaatagaaattgcttccccaaaaaatcgtcgaagaaaaagtgagctacaaatgacttagaatttagtctaaagtgtatttgatttaagatacccagcgagtatatcaaaaccaatattgcttcaacaacatttgttgaatacctgctaagtgcccaggtcctgagtttagcactgagaatacagagctgtttaaggacctcattgtctcatgggcctccatgttaatgtaattaattaggctagatgttaattaatagtaattagcagggctatttacagtggcacccacaccccatggtgttttctgctgtttagagcaaaacttggagtggtcctactaaataacctgaaagaaaaatgagtgctcttactttatccttaaggaaaggtgatctcaagagaggaataggtttgtccaaaggtcaccagcttaggaatggtaaagccagaattaaaattctattcccctgatccttaagccactacccttcctactttgtcatgttattgagctttctaggagaaaaatttgagccatattacttttgtcaaccttgctaaaatatttcatttctcttttcatattttatcattagtgaagattttatactatccaacttaagattttgtattagtgccttcataaatctttactgtggtctaattatagtaaataaagctgcatgtgtgtgtatgtgtgtattattaagctagattctaaaaatgaattaaatgagtctaatgatagtaaatgaagctgcatgtgtgtgttagattctaaaaatgaattaaatgagtgctttattatccaggctttatcactcaaatataaaatataacagcagcaatatgataatagtagttaacattatttatatgctaactctgtgctagtcctgtttgagcacttggtattcattgtctcatttcatcctaacaacaacctgataagatgatgctgttatccttactataaggattaggaaaatagggatttgaaggggttaagtcacttgctaaaggtcacatagcagataggtgtcaaagtaggccttaaaacctaggattgtgatactagagccagtgcttttaatcaggtgtcagaagtggatgaaatcaagcactatgggaaattatgatatttgactttatctttctagagcatctttatttactttcagtggcaagtgtgctagttgtttcatagctaaacaatcacatagtatgaatgagaatataatcagttgttgtttcatagctaaacaatcacatagtatgaatgagaatataattagtatacataagaattatgtttttaaattagtcccatcctgtttctagcatgtgagccctagttcaaatcccagctgtttcaaagctacttgttaaccaattgatagcaccttttaatttccccaccataatttttatgacataatttatcattagtcttccttgtgttatagatattcgaatttttttattagcttctctgctagattaagttatttacacagaagccatgacatatttatctttatatggcccatagtatctcatagagtgagataatgcaagtggaaactctttcaaaactcttaagcaattagagacagtgcataatcaatgtttaccaagtgtatattttctaagatgccttattgagctataagtatattttatgttttgaataaatttttactgcaatttgtgtaaaaattgttctttttgaacaattttactgactaaattaactgccctctgtgcccttttagtgtgtagatggggttttaggtggtgaagattataatcacaacaacatcaaccagtggactgcaagcatagtggaacaatccttaacacacctggttaagttgggaaaagcctataaatatattggtaagtatcagtatccttcctcactagttcacttgcttttgtcattgtgattttctctgaattttgagaaggtatatgtacaatagacatttaagttggatactaaaagggtataaaggacttctgatttactcattcaaagataatctataataatacttaaaagatgaagatctttcactactcaaaggcagtttgagctacttttctttggtagcatcaccctttgcatttccatcagttctttctttccactgagacccccccttagctcaactgtgtttctttcggtagtcccatgcctctttacctgtaattccacacagcaactgtttataaagtggagtatttcctgcatttctgtgtctgaattctgcccatggtacaaagcacagaatttgactgatatttttcctgcaatacaatcaccaatggtaatgacaatggtcagaaaaccaactgaatccagtggggtcaaaatcatgatggtagataaagatgagagtcttttatttttttttcaatctatttgctgaacgctttgttttctgttttttgtttgtttgtttgttttttgtcttgttttcggcttgtagagctctgaactcacacactttgaccttggttctcttttcctttgtctgtaagtgccctcattctgtgactttatttgcagtgacctgtgcagtggtccagaagagcgcatatggctttcacacagccagctcctgtttttgggataccacatctgatggtaagagatcttaagctgatttacacaaaatccaacttttagcaaagtcaaactgcactttttaaccaagtacttatttaattctgattaaattctgaaaagactatcaacag

SEQ ID NO: 1362 - DNA, 357 bp, mus musculus
cgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctt

SEQ ID NO: 1363 - DNA, 95635 bp, mus musculus
aaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataata

SEQ ID NO: 1364 - DNA, 15 bp, artificial
  synthetic oligo
agatcaggatgtagc

SEQ ID NO: 1365 - DNA, 14 bp, artificial
  synthetic oligo
tcagtccctcactc

SEQ ID NO: 1366 - DNA, 16 bp, artificial
  sytenthic oligo
cggtgcctagcatgca

SEQ ID NO: 1367 - DNA, 14 bp, artificial
  synthetic oligo
gttgattgatagga

SEQ ID NO: 1368 - DNA, 16 bp, artificial
  synthetic oligo
tggaaaggaggaggtg

SEQ ID NO: 1369 - DNA, 14 bp, artificial
  synthetic oligo
gtgtatgcgtgtga

SEQ ID NO: 1370 - DNA, 15 bp, artificial
  synthetic oligo
gaaaggcacgaagag

SEQ ID NO: 1371 - DNA, 14 bp, artificial
  synthetic oligo
ggatgcttgaaaca

SEQ ID NO: 1372 - DNA, 16 bp, artificial
  synthetic oligo
ccttacccctctaaaa

SEQ ID NO: 1373 - DNA, 16 bp, artificial
  synthetic oligo
aggagcttaaagtgag

SEQ ID NO: 1374 - DNA, 23 bp, artificial
  synthetic oligo
atgaatacggctacagcaacagg

SEQ ID NO: 1375 - DNA, 22 bp, artificial
  synthetic oligo
ctcttgctcagtgtccttgctg

SEQ ID NO: 1376 - DNA, 20 bp, artificial
  synthetic oligo
gcttgctacacagccattac

SEQ ID NO: 1377 - DNA, 20 bp, artificial
  synthetic oligo
gcttgctacacagccattat

SEQ ID NO: 1378 - DNA, 20 bp, artificial
  synthetic oligo
tagaaggcccagcacaaagt

SEQ ID NO: 1379 - DNA, 1650 bp, artificial
  synthetic oligo
agtgagctgagatggcaccactgcactccaggctgggcgacagagcgagactccgtctcaaaaaaaaaaaacaaacttaaaaattagccagctgtggcggtgcacacctatagtcccagctactcaggaggctgaggcaggaggattgcctgagcctaggaggtcgaggctgcagttagctgtgatcgcaccactgcactccagcctgggcaacagaccaaaacctcgtctccaaaaaaaaagtaaataaataaagttgcaatgactcccattgccgattcaaagagcttttatgaatgtctcaatatacttgcctagcctgtttttggattcaaacgcaaagttttgttcaccgtaggtgggagatcaagttggcaacaatagtgttccaaggtaatacaccctgtatctcagagaaattgaaatataaccatctcagaggttttttgtttctttggttttttgagactgtctcaaagaaaaaaattgaaaccctgctccagggctaggaacccacaaatttgagcacagctgtcactgtcggtatcaaacttgtctttattttttcagctgaggtcttgctctgttgcccaggctggagtgcagtgttgggatctcagctccttgcagcctcaaccctctgggctccaccaatcctcctgcatcagcctcccgagtagctgggactacaggtgtgcgccaccatgcctggccaattttaaatttgttttttgagagatgggggtcttgcaatattgtccaggctggtttcaaactcctggcctcaagcgatgctctcatatcggcctcctgagtggttgggactacgagcgtgagccaccatgctcggctgattttatttttaaattgtttgtagaggccaggtgcagtgggtcttgcctgtaatcccagcactttgggaggccgaggccggtggattgcttgagcccaggagttcaagaccagccttgccagtatggcaaaacctcatctctactaaaaaaaaaaatacaaaaaaaaaaattagccaggtgtgatggtgtgtgcctgttatcccagctactcgggagagtaaggcaggagaattgcttgaacctgggaggcggacgttgcagtgagctgagatcgtgggtgacagcgaaagtctgtctcaaaaagaaaaaaaaaaatcaatggtttgtgaaaatacagccggtgaccatggacccccctaggcacagcctcaagccacccagaagaagatggaaaaggattttcttttaaatcagcgagatttaaataagcatggcgagcacagctgggaggccccgccaggaattccgaaggttgaaaggggccctgtccgctcccccatcctggaaatagtgtccatggagctgcggagtccgggtgggcgccggggacgagctttcaacagctcacccggccccaacattccgtccacacattccacggccaagacagtcaccccctgccagggattaaccgagggccacgcttagtggcaggaatgcacgcgcccgatttagacatcccgcttggcatcggcggtcagggtggcttgcaaaggcccggggtgggtggatgccggagacgctggagctctgaggtctacaggaggaattgcttttccgatgggctggtcaggga

SEQ ID NO: 1380 - DNA, 4400 bp, artificial
  synthetic oligo
gtgttggccaggctggtctcgaactcctgacctcgtgatccgcccgcctcggcctcccagagcgctgggattccaggcgtgagccgcattcgttcccttgaccgtaaacgtctgcaggcgaggaatcagccgtcagtcaagagggagtcactgcggttcattcgcctctgacaacgggtcctcccggacgccgcgtggcttgttctgaagccgggccggagacaccgtctggaccccacgctgctccccagggccgcctccaagaggatgccccaccgcagggagccgtgcaaacaccataaatcctgctaattgccaccttcccggcagccagcatccgtggtctctctatagtggcctcacggtctccagccaggagctcgatctttgcttctgcacaaacattaccgagaaacgtctgcaaaccccgggcgcccggctcccacatcacaggcgctgcgcctcagaacacaacttgtttctgccgatccaccccccaccgccgcctccccgggcacctcgccacgcaggacgctccgggcttcccgtaagaacacccgtgtctgtgacctgcgggtggggtcacctccccggcctgcatgccaggtgaggcggggggggctcacctggggctctcacctgcccgagggggtcctgcccacggctctgcgacagaatagaatgatcagggcgatgcgtggcagtgccctctccctgccccagcccgagggcacctgttcccctcctatctcagccactctgcccacgtctgtccccacaaaacgcggtcggtgcagccctggggcccggtcaccgtaccgcatcctcctgacaaagacagaaagaaaccggctctttgattctaacattaaaaaaaaaagggctgccttctgcttgcaaaagaaatgcacgcaggctgctggcagaaagttctggaagatgataaaggaaaaaaataaattaattcgagaaaactttgagacgcctaacagcacaaataccctcagtctttagagaacagctggggatacacatattctggctcatttccccatggaacttttatttttattttttgagatgagtctctctgtgtcgccgaggctggagtgcaatggtgcgatctcagctcactgcaacctccgcctcccgggttcaagcgatcctcctgcctcagcctcccaatagctgagacgacaggcgcctgccaccacgcccggctaatttttgtatatttactagagacggggtttcaccgtgttggccaggctggtctcaagctcctgaccccaggtgatccgcccgcctcggcctcccagagtgctgggattatgggtgggagccaccgcgcccggcccctcttccttccttcccttccttccttcccttccttccttcccttccttccttcccttccttccttcccttccttccttcccttccttccttccttccctcccttccctccctcccttacctcccttccctccctcctttcctttccttcccttcctttccttccttccttctttctttttccttttctttttgagatgtagtctcactctgtggcccaggctggagtgcagtggtgtgatctcggctcactgcaacctccgcctcccaggttcaagcgattctcctgcctcagcctcctgagtagctgggacgacagacgcccgccaccatgcccggctaatttttgtgtttttttaggtagacatgaggtttcaccacatcggccaggccggtctcaagctcctgacctccagtgatccgcccgcctccgcctcccaaagtgctgggatgacaggcgtgagccaccgcgcttgtcctgctctgtaaattttgttttgggccaggcgtggtggctcacacctgcagtcccagcactacgggaggccgaggcacgagggtcgctggaggccacgagtttgagtcccccagcctgggtaacgtaacgagaccgtgtctttaaaaatcataaaagacagatcagctgggcgtagtgacacgggtgcctgtcgccccggctcctgaagaggctgaggtgggaggatcgctttagcccaggagttggaggctgtagcgagctgtgatctcaccaccgcactccagcctgggcgacagagcaagatcttgtctcgaaaacaaaacaaaacaaaacacaaaaatttaaaaaacagattgagaacccttggcccccacctcttaccagctcggtcacaattgcaaaccagaggccgggcacggtggctcacgcctgtcatcccagcgcttcgggaggccgaggcgggtggatcatgaggtcaggagctcgagaacatcctggccaacatggagaaaccccatctctactgaaaatacaaacttagccgggcgtggtggctcacgcctgtcatccgagcactttgggaggccgaggcgggcggatcacgaggtcaggagctcaaaagcagcctgaccaacatggagaaagcctgtctctactaaaaataccaacttagccgggcatggtggtgcacgcctgtcatcccagcgcttcgggaggccgaggcgggcggatcatgaggtagggagctcgagaccagcctgaccaacatggagaaaccctgtctctactaaaaatacaaaattagccgggcgtggtggtggcaggtgcctgcaatcccagttactcaggagaggctgaggcaggagaatcgcttgaacccgggaggcggaggttgcagtgagccgagatcgcacccctgcactccaggctgggcaacagagcaaaaactctgtctcaaaaataatataataataataataataataataataataataaaaacaactgttttcatgctgcagacagcacacaggccaggacgtcagggtctcgtgaggggccgtcggagaacgtctaagggacgtccctgcattcctggctggaggtcctgcgccagcgccctccttgtgagaacactttcgctctgcaaactctcagagcccccacctgctcccgcctcccgtctgtcctggttcttgggaccccggagccttctctgtccagacctcccaggtcctgacgggaatccggataaactccttggggcgaaggtgttaacggcagggcccctgtctaatgtatttcgccacccagataaaatgagtgttttcacagctgccgttaatttcttaccctgaggaagaaaggaaggactttgaggcacctgcggccgggttggggtggggcagggggatttctggacgcggacggcgtgtggggagttcctggggtccccagagccacaccacgtaggtggcagccggctccgtcctgcaaagccccggcttcggtgaaagatttatcacctgctcggcctcggagacggggaagaaaaacacagcctggaagtggtcctggctgatggacgggcccctggggagctgtccccaaatgcgcgtcttctttctcctttctgtcacagcctcccggccctgccctggctgagtggggctttcagtgaacgcttgttgagtgtccacggagctgtgagtgctgttccgggtgctgggtacgtggtggggtgtgtgaggttccctcctctctagtgcagagatcaggagtgagtagacaaagaaaatagcatctaactgctgcttgtgatgagttttttttttttttttttttgagacagagtcttgctcttgttacccaggctggagagcaatggcgtgatcttggctcacggcaacctctgcttccgggttcaaggcatcctcctgcctcagtctcccgagtagctgggagtacaggcacctgccaccacgcctgggtaattttgtatttttagtagagacggggtttcaccatgttggtcagcctggtctggaactcctgacctcaggtgatccatccatctcggcctcttaaagtgctgggattacaggcgtgagccgccatgtctggcctttttcttttttttttttttttttttgagatggtcttgctctcattgcccaggctggagtgcaatggtgcaatcttggctcactgcaacttctgcttccgggttcaaggcatcctcctgcctcagcctcccgagtagctgggattacacgtgtgcaccaccatgcccggctaattttgtatttttagtagagactgggtttcactatcttagttaggctggtctcgaactcccaacctcatgatctgcccgcctcagcctcccaaagtgctgggatgacaggcatgagccaccgcacctggcctatttttttttttttttttgagacagagtcttgctcttactgtgtaggctggagtacagtgggcgaactcggctcactgcaacctctgctccggggttcaaggcatcctcctgcctcagcctcccgagtagctggga

SEQ ID NO: 1381 - DNA, 5850 bp, artificial
  synthetic oligo
gttgaactcctgggctcaaggcctcctctcgctctggtctcccaaagtgctgggattagaggtgtgagccaccgcgtctggccaagacgtcttttgggggggacataattctcaaccaaattgcctctgtctctccttctcactctctctctctccacacacacacacacacacacacacacacacacagcttgtatgtatatacgcatttatacaggtgtggaggtgtttgtgcatatatagatatatatgatatatacgtatatttaagccattagaacatgatttccattgctaatatttcagtgaatatctcttttctagctctaactccacacacacacacagacacacagacacatcccttgtatgtatatatgcatttatacaggtgtggaggtatttgtgcatatagagatatatatgatctagatgtatatttaacccattagaaaatgattttcatgctgatagtacttcagtgaatatctcttaaaaatattgatcgcacacgtccctcatgaaaagcaatggttccctaaacacagactgtctggtccatctcggagtttccacagtcgtgactcacatgcaagcaatgtacaactatggcagggctgggctccttccctcccagacaggctcaaggttatgctccctgtgccgggatcagaatctggaatcaggacggccactccagtgacatgaaaggcacacgggtgacaggacggacaccccagagacaggacggacgccccagagacaggacggacgccccagagacagcacggagaccccagagacagcacggacacccccagagacaggacggacaccccagagacaggactgatgccccagagacaggacggacgcccccagagacagcacggagaccccagagacaggacggacgccccagagacaggactgatgccccagagacaggacggacgcccccagagacagcacagagaccccagagacaggacggacgccccagagacaggacggagaccccagagacagcacggatgccccagagacaggacggaggccccagagacagcacggacgccccagagacaggacggacgccccagagacaggacggacaccccagagacagcacggacgccccagagacaggacggacgccccagagacaggatggaggccccagagacagcacggacgccccagagacaggacggacgccccagagacagcacggacgccccagagacaggacggacgccccagagacaggacgggcgccccagagacaggacggacgccccagagacaggacggacaccccagagacagcacggacgccccagagacaggacggccgccccggccccgcgttttccatgacatattttctcttcggccacaggatggcagtgccagctacggaaacggtggaccgttgtcggaccctttgctgagttttgaaacacgtcactgccttcagccttgtgggtccccgggctgcgaaccccgggaccgccttcccgcctcgtgggccggggctcaggtctttacattcatcccaaaccgggttcaagccccatccctcccccggctgccaaccccgtgccgttcaggccccgtaaccggctacttcggaactgacgtcgtgaaacctttgctcgactgtgtttctgacgctcccgtcacagaacagaagctgtcgggagtgagcaatggtctagcccaggagaggaaaatcagccgcgtttcactttgcaccgtcatctcctcagccgccccgttccctcccacacttgcaagattccgagggaggaagccgcttctcggacccgggtcccaagctgtgcagaaaaggccaaggacacatttccgtgtctgtagacgcagcaggcggccgccagggcctcttgggcaaaagactcccattcccggctttgcctgcagacacccctcctcacacgggctctggaggtctgttggggttttcctcaaaaagtttattttttttgtggtttgcttttctagacagggtctcattctgtcatccgggggctggagcacggcgggaatgatctcggctcagagcagcctccggctactgtggcctcaagtgatcctcccgcctcagcctcccgagtagccgggaccagaggcacctgccaccacgcccaactcatttttttgtatttttttgtattttttgtagagacggggtttctccatgttgcctgggctggtcttgaactcctgggatcaagccgtccagcacctcagcctcccaacgtgccgggatgacgggtgtgagccaccgcaccgggcctattttattttattatttcttttgtagaaattgtttaagtggctacaaaagtccacaaacatcctccctgagattctcccttagaataatcgtcttcgtgggcacacagcatgtgctgctgctgacctgagtggcctcggctcgacgtctagacggctcagcgtttggacagtttccaatcagggtctgtcacccaggctggagtctgggtgtgatctcggctcactgcagcctgtttcctccctcccttcctttcctccctccttcctttcctccgtccctcctttcctccctccttcctttcctccctccctgcctctcttccttcctttcttcctggacagcctggcatctgcaccgtgtcctggctgagcctcctgccagctctgtggcctcgttgaggggggcgtgtctcaccatctttgcaccccagtttccccatctgtgaggcagggacggaaacaggcacccctcgaggtcacccctccagcatttgtttacagctgtctcacatgaacttagatccatggaaaagcgtcaccctgactcgtcgagctgcaaaaacggcccaggacagagaggggggcccttgggatggtggcggccgggacccgaggctgttgtccagtcatagaacctcagagcctgttcaaatcagggtctcgctctgtcacccaggctggagtctgggtgtgatgtcggctcaccgcagcctccacctcctgggctcgagcgattctcctgcctcagcctccggaggagctgggaccacaggtgcccgccaccacgctgggccgatttttacagtttttgtagagatggggcctcactgtgttgtccaggctggtcttgaactgttaacctcaagcgatcctcctgcctcggccatccagggtcctgcaatgatgggcgtgagccactgtgcctggcctattttttattgctgagggttttgcagaaatcatgtaagaagtggccggacgcagtgactcacgcctgtcatcccagcactctgggaggccgaggcgggtggatcaccagaagtcaggagttcgagaccagcctgggcaacatggcgaaaccccgtctctactaaaatacgaaagaaattggctgggagtggtggcaggtgcctgtagttccagctactcaggaggttgaggcaggagaattgcttgaacctgggaggtggaggttgcagtgagctgagatcgcaccattgcactccagcctgggcaacgagagtgaaactccatctcaaaaaaagaaaaaaaggctggacacagtggctcacgcctgtcatcccagcactttgggaggctgaggcggacagattgcctgagctcaggagttcgagaccagcctggccaacatgttgaaaccccgtctctactaaaatacaaaagaaattagctgggagtggtggcaggtgcctgtaatcccagctactcaggaggctgaggcaggagaattgcttgaacctgggacacggaggttgcagtgagacgagattgccccatcgcactccagcctgcaacagagcgagactccttaacaagggaggctattctgacacctgctaccatgtggaagaagcttgacaatattgaccaatcagccagacacagaaagacaagtcctgtgtgattccacttcgaggaggtccctcgagtcaccagagtcacagagacagaaagtataacggtgggtgccgggggctgaggagggcgaatggagctgtcgttgaaggggggggtcgcagtttcgggtttagaagtggaattttggagacaaatcacggggatggttgcagaaaagtgtgagcgtgcttgttaccccggaactgtgcacataaagatgtctcacctgttggccgggcgcggtggctcacgcctgtcatcccagcacttggggaggccgaggtgggtggatcacttgaggtcaggagatcaagaccagcctggctaacatggtgaaaccccgtctctactaaaaatacaagaaaaaaattagccgggtgtggtggcgggcacctgtagtcccagctgctcgggaggctgaggcaggagaatggcatgaacccgggaggcggaggttgcagtgagctgagatcgcaccactgcactccagcctgggcgacagagcgagactccatctcaaacaaacaaaaaagggctcgtgtgtatgaggctggggacgcaggagagggtctctccccctgaaactcggggggtcctgggaaagaatccagcctccagcctggccctgggaaccctggaccaggcagggggtcactgcccccttcctggggagtctcagctgaaaatagctcatctcacaggggacccgcacggctgacgtccaggacgagcccgagactcctcaagaaaagcctcgtgttaaacacacgtgtgtctcctcgcctgccggtttaatgcccagtcgtggggtcctgggttgtggccacgaagtcctattcctctgtcgccagggtgagaaggtggctgtcggcagggattttgggatcaggcaggtgacttctcacgaaggctggtttctcagcctcacatctgccgacatcgggggctggaggattctccgtcgtggggcgtcctgtgccctgtggggtgtcggggacatgttctcactcggaggacacattgattcaaaccataggatacacagttgattcatacatgtatgattgataggtgattggttgacagatagttgatggatagatattgatatagatgcatgattaataggtgattgacagatgatagacattaatataaatgtatgattgattggttgacagatgatagataattgatatagatgcatgattaataggtgattgacagataattgataggcattaatataaatgtatgattgatagatgattggttgacagataattgatatagacacatgattaataggtgattgacagataattgatagacattaatagaaatgtatgattgatgattggttgacagatgattgataattgatatagatgcatgattaatagatggttgataattgacagataattggtatagatgcatgattgatagatgatttattgacagacaattgatacataagcgatacagatgcatgattgatagggaattgattgacagatgattgataatttatatagatgtatgactgatcagtgattggttgataggtaattgatatagatgcatgattgacagatgattggttgtcagataattgaccgatagtaatggatagctgattaatagatagataattgattaatcaataattgatagatgatagataaagaatctctcatgcccaggcagctttctcagctctggcactgctgatgtttgggactggaggactctctgtcttggggccaccctgggtgctgcagggtgctaactctcttgatgaggccgtcctgggtactgtagggtactgagtctctgtgatgaagccgtcctgggctctgtagggtgttgagtctgagtctctgtgat

SEQ ID NO: 1382 - DNA, 1250 bp, artificial
  synthetic oligo
ggctaacacggtgaacccccgtctctactaaaaatactaaaatcagctgggcgtggtggcaggtgcctgtaatcccagctactcgggaggctgaggcaggagaatggcttgaacccgggaggcggaggtttcagtgagccgagactgcgccattgcaccccagcctgggcagcaagagcgaaactccgtctcaagaaaagaaaagaaaaaaaatgctcaggtacatttttgctttatttcaggatttctttacgttgctgtgaaaacctggatgttgggggctctgtctgtgtatcgtagacggagttttgaattgctccagtgaaacacaagtattttaccttacgctgtcaacctgctgggggaagcgtgaagacagtttaaccttctggctccggtaatcatcttgtctcagagacctcggagagctcccagagcctggctgccacggtggttctatataccctccagccctggcctgccttgggacacccctctccgcctgccggccccagaatttccccacacacgcggtcatcacagcccgagatgtttaatgacggcttcatgcaccaggctattgccctaaacacgggtgacaggccaaacacacactaattacctaactcaattcaagcccgcctggccccgtggaaaggctgagctggggatgcacgcaggtgccccgtcgttacctccggatgtcaaattgaagtgaggttttcccgcatgagcggggagagctgtttctacgcaccaagatttccacggtttgcaggagaaagagttttgtgtctgccctctggacagccctgtcagttttatcaagcgtgtctgattaaggaatatttaaaggtatgtgttcagaagcgtttctccccttcttttgtgtgtgtgtgtggccatgtttaaaaaaaacaaatgtaaaaccagttacaggcaaagtaggctagtttggtgctgaaataacgccgtcgttcatgagccggcttaaataatgcagttgttagaaaccagctctcaaagctgtgggttggctgaggagggttagtacgaggtcctgaccccaaacctgtgtgtatctggagccggcgggagacatttggcctggagtatgaggctggctggacctggaaggtcctcagcgttagagggactgtttcgggaaggttttctggcagctgagtcccaattccaggaggaagtaggcattgagtagataatttcagctcccccattgaagccgtcca

SEQ ID NO: 1383 - DNA, 1550 bp, artificial
  synthetic oligo
ccaccaccacgcctgcctaatttttgtgtttttagtagagacagggtttcaccatgttggccaggatggtctcaaactcctgacctggtgatccgcctgccttggcctcccaaagtgctgggattacaggcatgagcctccacacctggcctttttttttttctgagactgagtcttactctgtcgcccaggctggagtgcaatggcacgatctcggctcaccgcaacctccacctcctggattcaagcgattctcctgcctcagcctcccgagcagctgggatgacaggcccccgccaccacacctgcctaatttttttttgtattttcagtagaggtggggtttcaccatgtgagtcaggctggtctccaactcctgacctcaagtgatcctcccgcctcggcctcccaaagtgctgggatcgcggacgtgagccaccacaccggccaacattcacgcgattttcagaattagcagccacccgtctgggtccccacagtgtttggggaaagggatttgggggtgtggtacgccctgtgttccccggcgggcagctggggccggactcccttgccgacatcctgtgtgttctctgcatctcgaagttgtcacgaactctcatggcaacccccttctcgtgctatgggttccgtttagcctccctcagaattagctaaaaacccaccggcttgatttctggcatttgcaacggccgcgctcaggaaacctcctgcctcctgaaaatgctcatgctggcggaacgggaaggcaaataggaatccgtggatgataaatgggcgttttaagcagcagtttacttaatatccctattaaacgagactctttgcattaatcacttcattctccagcagtctataaggccctttaattgcttcttaaatgaggactgagtttccgtccaaactcaatcttggatggggagagagagatgctagccagggctcagctgcccggctgccaagaactgtcagaattgatcacgtatgtgttcacgtttcctacagtctcattggagttctctgagattgacaggagaaagtatcacatactttgtgtgtgtgtgtgtgtgtgtgtgtctgtgtgtgtcagagacagagggacacagaggccgggagcaggggtgtgtaagtgtgaggttctgaacgcaaagacaggccgttctgctcacaatccacaggccagcgaccttgtggaccattgcattatgtattagcaatatttattttcattttatgattttatttatttgagacagcttcttggtctgtcgcccatgctggagggcagtggtgcaatcatagctcactgcagccttgatcttccaggctcaagaaatcttccctcctcagcctcccaactagctgggactacaggtgcatgccaccatgcctgtctatttttttttttttggaggcagggtcagtcacccaggctggagagcagcggtgtgatcttggcttaccacaacctccgcctcccaggttcaagcgattctcctgtgtcagcctcccgagtagctgggatgaca

SEQ ID NO: 1384 - DNA, 2650 bp, artificial
  synthetic oligo
ccaggtgtccctgggcttgtggccgcatcactccagtctctgcctccgtctccacgtggacttctcctctgtgtctgtgtgtcctcttctgtctcttacaaggacacctgtcattgcatttagagctcacctaatccaggatgatctcacctcaagatcctcaacttaattacatctgcatgtgtgagtggcttcccggagacaccccttttctctcccattcctttttctttttccctaccatggaggacgaggacacgcacgcacgggaactcaagtttcaccccgtgagtattttaggcgtggggcactttcagcccaggtgtatgaaaatggtctcattaaggggactgctcggatgacacatccagtgagggtggcattgcctgtgtggcagttcaaagaatcggagacaagctctagagagagcgaggacacacacaggtgcacgcatcacacacacacacgtgcacacgcgggcacgcacacacaggtgcacacggccatcaccccggccgcgtgagagtgttgcttatatcgaaaccgtcttcagcccagaaggtcactcgtggcaataatggtctcgttagacacgccatccatcattcaaataatcgcaatttagagcccgcgtttcatgccgggctggtttaatcaccagcagcagtttgtgaagggcctcattcgcctgggattcggggatattgcgtgatttagcagacgtgacccctgacctctgcggggggcggagagcctgccttggaggcaaaagcggaacagcgagggtgactcactcagggacaattattatgcttaacagcctcactgtcatcttagaaggaaaaagagccaaaaaaaaaaaaaaaatccataggatgctgagcattccttccagatccttcagcattccttccagatccttcagcattccttccagatccttcagcattccttccagatccttcagcattccttccagatccttcagcattccttccagatcccagtttagaagaaggcagtggggtcggtttaaatgcacccagcgtgctcccgaagataatgtttttgtttctgtagacgcggtggcagctttctggcgatttctaggcaatgtacaggaggaaagaaagaaggaaggggagggcacggagaagctccggaaggctggatgcttggggaaggaggtcaggaggcaggaccggccggccgccctccagacgtccagatgtccagacgtccagccagccggacaccggtctgcacctgtcacaggtgagcagcatttgttagcgacgtctgcacaggcatcagttgggtaaaggatgttcccgtgttgtacctggagcgagttagagaaaacgccacactttgagacgaattaagagtccgtttatttagccggcggccaagagacggctaacgctcaaagttctctcggccccgaagaaggggctagattttttttttatactttggtttagaaaggggagggggatctagcgaaaaccattttacagaaataaagtaggcaaaaaagttaaaaggataaatggttacagggaagtaaacaggtgcagggcctttaagactattacaaggtgatagacgcagggcttcgggcgttagtaatcagacgaattcctgggaattgcggatatagctcgccacagtatcttatcagttaattgcattcttggatgtgctgggagtcagcttgcacgagttcagtccttgaggaaggggctgccagtgaaagagccatgatggagtctgtctggttctcttagctaagggtgagtccattcaggtggaaacaaggctaggtgattgaaggaaaagggagagtctaaaaacagggttagtaaaaaggaggttgggcattacaggtgaaaccccgtctgcccgagccagcaaacgctgctcacccgtgacaggtgcagacccggtctccggctggtcctgcctcctggcctccttcccgaagcatccagccttccggagcacaggcagacgggtacaggatggtccccaggccctcattcacttggaagcaacaggagaaaatcctctattgcatttctgcagccgtccgcatttctgcgcacagagacggttaaatgcttgtcatttaacttgtcattctctccataacacagtgttctatttttatttccatcggtgcaaagctcatcactctccgtcccctcctgcctgggatgcttgcagcccccttcctgagacggtggcgatcccccagtaccagatttttggtgatcccagggggccacgggctgtgcctggcatctctctcatgaaacatctctttttcttgtgatcatttaaaattcatcctcgctccaaagaaggtatctgtgtagcagtgttgcctccgtgagccgtcctgattttttttttccggtatttcaaagggaggttaggggatcgggttatttttggtgagaacagcgggaaaccaagccttgacttctcgagtccctggggtgcaggagaggggtctctgaggaccatgctgggaaaataactcatccctcctttggtcatctttggagatgagctgaaaccaggcggggctctagtcacttatttatctgcttcttaaattttattttatttatttatttttttt

SEQ ID NO: 1385 - DNA, 2050 bp, artificial
  synthetic oligo
tgtgctttttccataagacaaatgcaaatgagccaggcattctaacgaggcgagccctcggaggtgacctctttctggggaagctccggtctgcaaaaccacgatgagagaggaaaacgtttttttttttttttgcagagaaaactcaggcctgctgtttaatcagggcctttgctgcggccgctgctcctgcagacacagaggcgttaatgaggcaagactagtccccatgtccccacgttggaggcctgggatgaggatcccttctctgtcccccatgtctgcatcccaggacgcaggtggatccgagtctgctgcatagacggccattaggtcccaggatggagctggattcgagcctgctgtgtagacggccattaggtcccagtcccaggatggagccggattcaagcctgctatgtagatggctattaggtcccaggatgcaggtggatctgagtctgctgcatagaaggccattaggtcccaggatggagctggattcgagcctgctgtgtagacagccattaggtcccgggatgcagctacatctgagcctgctgcatagatggccattaggtcctgggatggagctgcattggaccctgctgtgtagacagccattaggtcccaggatgcagctacatctgagcctgctgcatagatggccattaggtcctgggacggagctgcattggaccctgctgtgtagagagccattaggtcctgggatgtagctgcatccgagtctgctgtgtagacggccattaggtcccagtcccaggatggagctggagttgagcctgctatgtagatggctattaggtcccaggacgcaggtggatccgagtctgctgcatagatggccattaggtcccaggatggagctggattcgagcctgctgtgtagacggccattaggtcccagtcccaggatggagctggagtggagcctgctatgtagatggctattaggtcccaggacgcaggtggatccgagtctgctgcatagatggccattaggtcccaggatggagctggattcgagcctgctatgtagatggctattaggtctcgggatgcagctacatctgagcctgctgcatagacggccattaggtcctgggacagagctgcattggaccctgctgtgtagacagccattaggtcccaggatgtagctgcatccgagtctgctgcatagatggccattaggtcccagtcccaggatggagctggattcgagcctgctgtgtagacggccattaggtcccagtcccaggatggagctggagtcgagcctgctgtgtagacggccattaggtcccagtcccaggatggagctggattcgagcctgctatgtagatggctattaggtcccgggatgcagctacatctgagcctgctgcatagacggccattaagtcctgggacggagctgcattggaccctgctgtgtagacagctattaggtcccgggatgcagctacatctgagcctgctgcatggacggccattaggtcctgggatggagctgcattggaccctgctgtgtagacagccattaggtcccgggatgcagctgcatctgagtctgctgcatagatggccattagatcctgggacggagctgcattggaccctgctgtgtagacagccattaggtcccaggatgtggctgcatctgagcctgctgtgtagacggccaaaataaataacaaaactgtgttggcaggcggtgaccgacagacgaaccactgggctctcatcccggccggccctttgagttgtttaagttcctcttgtacttgaattgtttccccagaacgaggtggatcaaagtgtcatacagtaacagcccagacagacgataggtatggcagaaaagaaaaaaactaaaaaaaaaaaaaaaaaaaaaaatcgcatgggaagtttccccgcctcctctttggccattctgtgcccggagatcaaagttctcatttcagctctaattaagaaaaactaacacagagccaaggccttctggctccgaagagggcctttggt

SEQ ID NO: 1386 - DNA, 4550 bp, artificial
  synthetic oligo
aaggactgggctgatggggaccctctgtatgtgatgtgcgtgggtttggtttcccggaaggccctccagagacacgtttgcgtgaacattcagcatggaaacaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgatgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccaggccggaggagtgcaggggcgcgatctcggctcaccgcgacctccgcctcccgggttcaagcgactctcctgcctcagcctcccgagtagctgggatgacagtcacctgcaccaccgcgcccggctcatttttgtatttttagtagcaatggggtttcaccgtgttggtcaggctggtctcgaactcctgacctcgtgatccacccgcgtctgggcccggccggtgatgtgtgtgcttttaacttttattttgttccagttttcgacagtggcacggattttccagcacggtcttgcaaggatgattgagtcatttttgagacaaaaaatataataataataaatggaaaaagaaatcgacttttaaaaatgacaaatttttttttttttttttgcatagatttttctctctttatgtaaaggaaagttcatgattggatttggccggcctgactgcttcccggctgtgataaaaaacacatgtgagctgggagggaagtgggggagggacacagctgcccacacagggttcccaccgcggttacagggtgggcagtgctgggggagctttctctgtggggggctcagagcctgaggacaggtgagcctctccgacacctccccagttgcctggagtctaaaccgtccgttgtctgtaccgtccgttcttcctgctgactcctggtagttcctgaaagcttctcttggccagagaaggggtttcagaggccgtgtgtccaggccattctgcaaagtgcaacttgaccgttcctttccttttctggcctgcgtggtctgaagctcagagccctctcttcacccagcctgtgtgtgtcttgccggacagaagaaaaatggtgctttttgcgtgttagcagaggtgcttttcatggctgacctcaacgcgtccatctccagcctgttttttaggggcaaacgcaggcaagttctgaatgcacacagttatttcatggttaaactattcagctttggccgggcgcagtgtggctctcacgcctgtcatcccagcactttgggaggccgaggcgggtggatcacctgaggtcaggagttcgagaccagcctggccaacacggtgaaactctatctctactaaaaatacaaaaattagccgggcgtggtggtgtgtatctgtaatcccagctactcaggaagctgaggcaggagaatcgcttggacccaggaggcggaggttgcactgagccgagatcgcgccattgcactccagcctgggcgacagagccagacgctgtctcaaaaaaatgaataataaaataaaataacaggaactaaataaaataaaacgttcagctttgttctgcaaatccactcctattgttttacgtggtttgagagactctgtcccttagaaatagatgtttgttgccaattgtaatgaatctgtttcaaaaatgaacagaatattcaaatggtttgagagatcttttcccttagaaatagcttgttgccaatcacaaagaatgtttttcaaaaatgaatggaatcttcctggatatcgcttccagatcttcattttttttgcatagttcaacctgaaaagtaagtgtctcagccctgaatttctttctgatttttccatgggttgtcttgcagacttctctggacttgaccacatttaaaaaaaaaaaaattaactttttcacacggacacggtttcaataggaatgagatctttgagtttttatgtaacagattcttaccatcagttctcagattcccaaattacacacaaaaagccacggacttcgcctcctgctaacatgtccttctgtttctgaggcttctgttggtgttagactttcatgtttaatagcagacaatgtagggatttaaagaaaaatgcagagaaagcaaaaacactgaccaaacacacggagataagctttctaaagcctttgttcttggagttg

SEQ ID NO: 1387 - DNA, 1900 bp, artificial
  synthetic oligo
caatcttctgtgggcctgggcctggggggtttccccctttctctgcagcccattgggaggaagaaaatgcttccctgaagttgctgcaaaattgtttctgtttttcttctctttttcttttttttttttttttttgagacggagtctcgctctgtcaccaggctggagtgcaatggtatgatctcagctcactgcaacctccacgttcctgtttcaagtcattctcctgcctcagcctcctgagtagctgggactacaggcgcccgccaccacgcccggctagtgtttgtatttttagaaaagacagggtttccccatgttggccaggctggtcttgaactcctgtcctcaagtgatctgcctgcctcggcctcccaaagtgctgtgtttctgttttcctttcccccctttcttaggaggccgtcgggaagaataaaatgctttccttgaagttgatgcaaaattgtttctgtttttcttttctcttttctttctttttgagatggagtctcgctctttcacccaggctggagggcagtggcgcgacctcggctcactgcaacctccgcctcccgggttcaagcgattctcctgcctcagcctccggagtagctgggattacaggcacctgccactatgcctggctaattttattatttttagtagagacggggtttcaccatgttggccaggctggtctcaaactcctgacctcaggtgatccgcccgcctcgcctcccaaagtgatgggatgacaggcatgagccaccgtgcccggccctctaactctttaccagacataaagtctccttcccctttctaaatgtatatattgtgtttttaaaagttaacagcagggatcccacctcattccccgctctctccccaagacctgtcctgcacgttgcacacagcaggtgtgccctggacatatcccaaacccacgctgaaagaaagagggtctcactacacgtatgatatctgtgatcctttaaacatctccgtggcttccaggcaacacagccataaataggaatctcatgtctgacatgataccgggaccatgtatgggaaattctgggtgtgaagttccagctacccccgcagaggcaccattgcataccctccagaaactcccctgccgttcaagccaaagacacaacacaaacagctccgagagagggtgtcattgaaaatcaataccatcataagagcacacagcaccgtctttctcttctgcccgttgatacacaattatgagcaatttgctaacactgacaactcgtggcaagaacaggtcgtgttgatacggttgcctcgtgaggacccatctgtcttctggggtcttgcctggaacggagatcggagttcagggtggctaatagaatcattactcacctagggacacagaatatgagggttacccccagttaagtgcatacagtcaaacggacggctgctctggaaggtacagtgacgtgaacagcttttatgaaatgcctagatctggaccttccatacctgagccaccgttccaaagcactgggcgtttttcagatactttcatgagaaatgttgtcaacaccgcaagtttgcagtacacagtctgaaagatattcttgtatatgtagatgtctgtagatgccctgaaggtgtgtagactttagacacccagaaggtgtgtagatgtctgtagacaccttctatgtgtgtagatgtctgtagacgccctgcaggtgtgtagatatatctagatggtctgcctgtgtatgatacaggctaaaaagacatttgtggtggacactagttgattatttaggactatgagatgggaaaggaagagcaaccagcagtgaaaggcatgtggtgggtggggggttggcattgcagtggggtcctc

SEQ ID NO: 1388 - DNA, 1650 bp, artificial
  synthetic oligo
gtgatccacccacctcagcctcccaaagtgctgggatgacaggcacctgccaccacgcacggctaatttttgtatttttagtagagacggggtttcagcatgttggccaggctggtctcgaacgcctgaccccaagtgatccgccagcctcggcctcccaaagtgctgggatgacaggcgtgagcccacaagcccggccaagatttaaaaaaaaaaaaaaaaaaaaaaaaaaagtcactgttgaaatactggcacgtagaatgccagagatgaggaggattctaggtaggacaacagcaaccttcgctcccggacaacaggtagcaacatcgtcctcatatccctggccctcttatcgtcaccttcccttccacgcctccctcgggagcgattgtatctattgtctcccagccccgatgatggatgctcagggcactcatctctctgagtgatcagtattttccgtgttcttctcagagtctctgacactgtgggccgggccctggctacagctgacgagtgtgtgtgtgtgtgtgtgtgtgtgtctgtgtgtgtgtgtgggggggggggttcatttacatttcaatcttcacctcatgaatgtaaaagctcagccggcaaattaataacagggtgatgaggacgcctccctgcactgggaaggggggcaccacctcccctcgtttccaacccctagaagccgacagccccttcctggccattgtgttcggcagccgtctcatttaccggcccgcggtgaatgacattacagagaaaggcatatccagagtgacacaaatgtatttctgtcccaagcaaggcagtctattttcatagaatcaaggggctatttgtctggggacgatttagtttccatgaaaaattaaaatggttttctgtgctgctatagggtggcgaaatttaatttgtcactcgtttactaaagcaggtataaaaaggagaagaattggatgtctgatgggctgaaattggcgacgtccctcggtttggtctcccaaggcctggggacgcagaggcctgtcccggccacccccaacgcccccctctccccaccctcggaggacctggtcatcttaaaccaacttacagaaaacctttggggaggctgtgccaatcacccggaaaaccacgttcctatcgatcccctgtctgcgtgatttatggcttcattttacggtaattgagaattagtgaggagatgagcaggactgcacgtggtgacacggggtccacatctcattgaattgcgggatgacgtggaaattaatgtgacacacgggagatgtggaacagggggccgtgtgtctccagcatcacacgggcgtccccggtcaccagcaccccctccccggtctgccttcgaaggcaggatgaggatgattgatccgaatcggtttcaatccgtctcaactgcagcccggccgatggacgggacactcacaattggattgagcctcctacgaacaaagttcatcgacagccacccgcaggtcaatggctgcagctcaccagcgtggcacacgtatacgtatgtaactaacctgcacaatgtgcacatgtaccctaaaacttaaagtataatcataataaaataaaataaaggaaaaaaaataggaggtctcgtgtcat

SEQ ID NO: 1389 - DNA, 1200 bp, artificial
  synthetic oligo
aaaaaaagcactttgattcaaaataaaatgcaggcacggtttaccagaacatttttatctcgctttgaagagccaccgaagaaaaaagatcccacagctatacctgtttgttagatggtctagcaaaaaagaagcaatttgcccatgcaaacttttatgtttctgagatgctttttctgcctgcggtttgagtattttcactgaatatgagggcaaaataattgcatttcagccgtgatgaactttaacacacactctaaatattagaattccttaggatgtttaggggagtttatttttagtttccgtccttaaacaaagccccacgctctgttctgccacaatgtggacttgattagttaaaaatagcctggaaacatttctaatgaaattaaaatagcgacggtcacctcctcttcatgtacccttcagtattgtctaacatgtacctttgtagatttcgttcccaaataaattagaagagtcatcatcaataaaaaaaatgtgtggaagatgcaaatcccgagatgaaaatcatttagcatttttctaagtttagaacccagggagagagaatagcagtatctggttgcttcagaagcttttctcttgcagggaaggggggggggacaggggatttggaaaaacgacaccccagactctatttccagtctatgccccagtgggtacagttgctggggtattttctcttcctggtgtcattgcaggggacgctggagagatcttgcaagctgacctccacaaggaagagcataggttttaaagacggaacaaaacaagtaggatttaaagatggaacaaaacaagtaggatttctaaggcagttacccctttgccttaatttcaccaggcagggaacactggatacaattaaaacattgtctcaagataaatgcacagctggcttttttcatccacatgtgcacctgccaggggcttgagcttgcaaatgctgcaaatgccgggttgtatttatgcaactgccgcctcctcccaagcctttccgaagccgacctgtcctgtgttcagccccagcgtctatgctattagacagatgagggatatttttccatcataagcccccagacggcaccggatactgtctcctgaactctcccaacttggggatcctggaggaatgtttttaatggatgcggcttgcctgtgcatggctaactc

SEQ ID NO: 1390 - DNA, 1300 bp, artificial
  synthetic oligo
tgtgtccagcgacttgggactatatggcctttgaacgtctgaacaccctcagttctccttcatattctccagctcccctgcatggagatgtgggccttttagggttctttccacccctttagggcctctctgctagccttccattggcaaggacaattgccaaaaggaggtatccagctctaaccctgcagaacagacagagagcccagtagcctggcagccagagaggctttctctaaaacaggcatccctggcagcctcattgaaatgggaagattcattatcccatttccatttaattgttattttgccggcagaaaagcctggagtttctctgaaaggcagtgatggtgttgtccttttagattccctggggaatgatctttaaaaaattgcgtgcccagcttcccaagtgcccagcatttgccttgacattaacttactctatgaagtacggatgttgcagaggggagggcatccaagcccctggcttcccggagaaattggtaagggttgtctgcagcttcccagccttaaaaatacttgacaagttgacatcctcactgctaagtggggctgatggagcctcgtcaaccccaggacccgctgatcagccgtggcaggaatcatacccacagccttatgcgaagtgatgagttggatttgcttccagcagggtgaaagcaattggatttcacttgttctcaatgtacagcaagagaaaagtgggggactgactcagagaacccgtgttccctccatatgcagctcagtcatctctgaaatacactgcaaattgtttaaaccttaaaaacagagcggcgtgaatgtgcctcctgatggcaccgggttttgataagatgataggctgtggcgatggatttcagatgtgagtttctgtgcttgccaaaatgctgggcgaaagatgaaggtaattgctagcattgttggccttgccaataatccgtctctctctctctctctctatcctctctcctctctcctctctcctctctctgtctctcgttttttcttttttattttgcttcaagaatctggttgccttaatgagaaactttgcccctgctaagctaacctttcacgtctggaacaaaacacagcagctccgcctcagccacagtgatagggagccttgtggacctgaaacctctcggtggccaaaccagaaatgatttttgacaggaccaggctgaattccctgagtacattcacggccacccgaccctctcctctccccctccttttttttttttttttttattttaatggtccaaaattg

SEQ ID NO: 1391 - DNA, 3200 bp, artificial
  synthetic oligo
acacaatgagagtttataacgtgacagaggtggttttcgaattcattccattaaaaaaaaatccaagatttctgtgtgtcacaaaatatttacgaaattaaagggaagttcagagaccacgtggaaaatacattctaaaccaaagcatcattactacacaaggaggtgtttcaaatcaaacgtgaagtttcccccaatgaaaaagtcaaacggcacaagataaacggtcggaatcaacagaacacgttcgacttcagtaaagattacagaaatactttctttaaaacaaggagacctcacttgaattttctacattgcatgcttttctgccctccagagctgaaaactcagaagctttgaaaatgcccattctcttggctgggcgcggtggttcacgcctgtagtcccagcactttgggaggccgaggcgggtggatcacctgaggtcaggagttcgagaccagccaggccaatatggtgaaacccgttctctactaacaatacaaaaattagctgggtgtggtggcgggcgcctgtagtcccagctactcaggaggctgaggcaggagaatctcttagaacccgggaggtggaggttgcggtgagccgagatcgcaccactgcactccagcctgggcgacagagcaaaaaaaaaaaaaaaaagaaagaaagaaaaagaaaagaaaatgcccatcccgttggatccaggcattgcattttttaccaagtgttacaaagtcaaaacaagcaaggagaaatcacagtaaaaagaaaattacacagtgcaaacacgcccaaaatgagaagcttgtctgtgcggaaggagagatgctttgtgtgctttagagatgttttacttatatgggtgaaaaatagatatatgtaaaaatagaatatgtgaaaaatagaataaaatcacatatatgagaaatagaattaaaaatgacggctgagtgtggtggttcacactggtaatcccagcactttgggagaccaaggcgggaagattgcttgagcctaggagtttgaggccagcctgggcaacaaataatacaaaataataatctctacaaataatacaaaaaaagccaccctcctgcctcagcctcccaagtagctgggactacaggagtgtggagtcccagctacttgagtgtggtggcccacaccaatggtcccagctaatcgggaggctgaggcaggaggattgcttgagcccgggtggtggaggctgcagtgagctgtggtcatgtcactgcactccagcctgggtgacagagcaagaccctgtctttaaaataaaacagcaagccaggcgcggtggctcatgcctgtaatcccagcaatttgggaggccgaggcaggtggatcatttgaggtcaggagttcgagatcagcctggccaacatggtgaaaccccgtctctattaaaaatataaaaattagctgggcatggtgtcatacacctgtaatcccagatactcaggacgctgacgcaggagaatcatttgaacccaggaggcagaggttgcagtgagccaagatcatgccactgcacttctgcctggtctccagagcgagactccctcccaaaaaaagttgcagcgagagagaacggacaaacagaggagtcaggagaagccatggggaagagagaatggaagaaagaggctcaaactcagaccctggagaaggagaggggcagggttggccacccacaaccgtatccacagtccagagaatgctgtagttacaagatacaaataggaatatcttgatctcctcacctcagtgaacatggggatgcatagttatcctatttatttcttaattattatcattattattttgagacagagtcttactctgtcacccaggctggagtgcaatggcactatctcggctcactgcaccctccgactcccgggtttaagggattcccctgcctcagcctcccgagtagctgggattacaggtgcccaccaccacacctggctaagttttgtatttttagtagagaaggggtttcaccatgttggccaggctggtctcaaactcctgacctcaggggatctgcccgcctcggcctcccaaagtgctgggatgacacgtgtgagccaccgcacccggcgagttatcctatttaaataaacaattaagtgttcagcagtggatgacttcagcaatgagttagaagacgaccgagcagaggtgaaggagatgtcattccatttcctcgtccaggctggctgtccggcctccccgcgtccctcggaagacgatgctgaaatcccgttgtgtctatggcgatggcagacgggggacagccagattctgaaggcgtccccggctacatctgttcccattttctcctcggccgggccataccagcgggagcggaaattcagttttaataacacagaccccccaaacccatttctgaaggcagtttgtggggtgacctcagtgtggattgtaaatataaaattcatatgtgctgggcttcctgactgtaattacctatcaaaagtttcagggtttcagtgaaattccttatgaaacaacaaatagtctcacggtggaatctcacccccacctctccctctctacatgcctgggacagagaattgattcttacgtttcatgcacaggacagacaagtgtatttggtattttaatcccatcccaagatgtctgtgtggagttaattttcctcatggaatatttcctttctgctcatgtgctgcaggagaacagctacccacgactctccaggcagtgtggcaggaggagagagaagggcaggctctgcagaattcttcgtcttggccgggcacagtggctcacgtctgtcatcccagctctttgggaggccaaggcaggaggatcacctgaggtcaggagatcgagaccagcctggctaacatggtgaaaccccgtctgtattaaaaatacaaaaaattggttgggcgtggtggcaggtgcctgtaatcccagctactcgggaggctgaggcaggagaatcgcttgaacccgggaggcagaggttgcagtgagccgagatcgcgccactgcactccagcctgggcgacagggcgacactctgtctcaaaaaataaaataaaataaaataagaatcccctgtcccttccttctgtggtccaagacacagggtgtgaagtttgcaatgcaacagaacc

SEQ ID NO: 1392 - DNA, 1600 bp, artificial
  synthetic oligo
ctactcaggaggctgaggcaggagaatcgcttgaacccgggaggcggaagttgcagtgagccgagatctcacggttgcactccagcctggtgacagagtgagactctgtctcaaaaaaaaatacaactttaggccagacgtggtggctcacacctgtaaatcccagcactttgagagtctgaggtgggcggatcacgaggtcaggagttcgagaccagcctggacaacatggtgaaaccccgtctctactaaaaatacaaaaaaattagccgggcacagtgatgggcgcctgtagtcccagctactcaggaggctgaggcagaagaatcatttgaacctgggaggcggaggttgcagtgagctgagattgcaccactgcactccagcctggcgacagcgtgagagtccgtctcaaaaaaaaaaaaaaaaaaaaaaaaaaaacttaaagaaaaaaaagcagccccttaattccggtattcccggctgatgccaggagaagctgctgagtgtgacatcctcccagctggctggcggacaccgtctagtttatatattcagagacatcatttcagccacctctgtttcctctgccgtcaaatacatgactggaggtagcttctgaaagtcctcagccgtaacgatccagcaggctcattaatagagacggaacggatcatcactcgcttacttatcgggtacaaattgaaatcttcagagtcccggctggttcattagcaaatcaggcctctgtgggacaacatgatacattgcctaataagcaattaatagattcctcagttatttgatgcatgcactttgtgtgtgtgtgtgtgtgtgtgtgcgtgtgtgtgtgtgtgtgtgtgtgtggttggagccaggcggaacgaggtcctgtccacaactttagccattgtggtatctgattagaattgaccattcaatgtcaaatgaattccgatgcatcctaacggcggatgtcactggcctaaggaccccccagttaagccacctgccccatcctacgtggacatctgctgtttttttggttagttggtttgtttgtttttgagatgcagtttcgctcttgttgcccaggctggagggtaacggcacgatctcggcccactgcaacctccgcctcccgggttcaaacagttctcctacctcagcctcccaaatagttgggattacaggcatgcaccaccacaccgggctaatttttgcatttttagtagagacagggtttcaccatgttcatcaggctggtctcgaagtcctgacctcgggcgatccacccgcctcggcctcccaaagtgctggatgacaggcgtgagccactgcgcctggccggatgtccactcttaaatacaggtgcactttccaggttgacccttctggctggtggacttacaggtgcagcaaatcccattatttcattcctttcattgcttaactctcctactgagtcctcaaagtccattatatcattctcatgcctttgcgtcctcatagcttagttcctacttataaatgagaacataatgatgattgattttccattcctgagttacttcccttagaatcatggcctccagctcca

SEQ ID NO: 1393 - DNA, 2050 bp, artificial
  synthetic oligo
gatggtcaggctggtctcaaactcctgacctcaggtgatccgccagcctcggcctcccaaagtgctgggatgacaggggtgagccaccgtgcccggcctctggtttgcaattgtgactgagctggtaagaggtgggggccaagggttctcaatctgtttttttaatttttgtgttttgttttgttttgttttcgagacaagatcttgctctgttgcccaggctggagtgcagtcgtgcaatctcagctcagcgcagcctccaccttctgggctcaagccatcctccttcctcagcctcccaagtagctgggactatgggcattcataccacatccagataattttttttttttcttggtacagacagggtttcaccatgttgcccaggctggtctcaaactcctgggctcaggcatcctcagccttggcctctgatagtactgggattataggtctgagtcacagggcctgtctttttgtttttgtttttgtttctgttttgtttgtttgttttgagatggagtctcgcccaccgaggctgaagtgcagtggcgtgatctcagctcacggcaacctccacctcccaggttcaagcgattcgcctgcctcagcctcccgagtagctgcagttacaggtgcccgccaccaaacccagctaatttttttgtatttttagtagagacacggtttcaccatgtcggccaggctggtctcgaactcctgacctcaaatgatcctcccacctcagccccccaaagtgctgagattacaggcgtgagtcaccgcgcgcccggccactgtttttcttttccttttcttaaataacagcaccattgcacagctcatgagcgctacagaaaacacatgttaaatgttttccaccaaattttggctttttattgcggttgaaaataaacaagtaccagaaaatcagatctttttgtaaaatgttaaacacacattatgggtaatgtacacgcctgtggcttcctgtacggccacagggtaattgaatttgattcgagttcatttactcctgccaaatcaagccccaccgaacaggtgttagatgttgttagagattcagctttgaaatgtccatttctctcttcctttcaacttctggatgtgctgaactggggaaaatcctgtgagtataatttacatgttcctgctgccttccacgctacggtatcggagcacctgatgacttctttatatggggcatatgaaagcaaactctgaaatgaggccgggcgcggtggctcacgcctgtcatcccagcactttgggagaccgaggagggtggatcgcctgaggtcaggagttggagaccagcctggccaacatggtgaaaccccatctctactaaaaatacaaacactagcctggcttggtggcaggcgcctgtaatcccagctactcgggaggctgaggcaggagaatcgcttgaacccgggaggctgagtttgcagtgagctgaaatcgtgccactgcactccagcctgggcaacagcgagattctgtctcaaaaaacaaacaaaaaaaaatagtcactcatgggcatcgccttattttccattgttactgcttattgatacattcagggaaatactggttttacaattttacggttgctagaagttggaatgaaaccacaagtaatgagtctcactttatttgatgatttggtggtcttgcgttctttgaacttattctgggttaattctctatgtctcttctttcttcaacttcaaatttggatctctgcacaattttctgcaatttgttttttattttttatttttttttgttctttcaggtcccctatcatcttatgggctcttttccatattaatcgtgttttattttgtcttttctgtatcgttctttgtttcatttttcttttctatcctctatttctctctctttcttgtattttgaaacagagtctcgctctgtcacccaggctggagggcagtggcgcggtgtcggctcactgcaacctccacctccccggttcaagcgattttcctgcctcagcctcccg

SEQ ID NO: 1394 - DNA, 7950 bp, artificial
  synthetic oligo
cagctactttttttgtatttttagtagagacggggtttcaccatgttggccagggtgctctcaaactcctggcctcaagagatccacccgccttggcctcataaaatgcttgcattacaggcatgaaccaccctgcccagtcctaaatttgctttttacaggggatgcctttgcaaaggtagcctgaagctacatcagggctcttgtacatgagctggtcacatgagagtctgcctaaaagtagaagaaggaaaaaaaaaatcgcagtcctccaaaggctatgataaccaagggaagtcatcccaagacgtgtgagtggctggattctctatatccatccaggagagaggattgggggtcactgggagcaaggtttatcgtgagacaacttgagatgtcttcctgcgggcacgaaaaggaccaaaacactctggaataggattgcttggggcagaaaggtcttcagctgaccacatgctttctgagcacctggctttacgcagaaccctgtccgggaaatgctgggtgaagagaacacgctgtccagtgggcttgggagggcctcatcttgtgccggcttcagccaattggaaaaaaataaaagatgagccgattatgtaaggcctgacatggtactgagggctctctgagcataaattaacttccccacacagcccgcctgtgaggtaggtaggaaggtgggcggtaaacgtgtgtgccaattttcatctggacctcagagacccatggtagttcagcaaaggccacacagtgagctgggtggagggaacgtagaaactctcaggcatccgccaggccccgtcccatactttggcagggaggtttttattaaaatgattaaggaccgaggtggtgatcccgggaaaagttgttgaaaaatgaaagtttgggcctctgagttaatggtttaattatgcgtctcaggatttgcaaagagcacagtcatcttatgtgtggggcggattctgacttcccgtccagcctttcatttctagagacaatcggccaatttatacttaggggaaaatgaaggacgagctgaaagaatggcagaaagtccatcttccaagctcttcctggaaatacagaaaagaaaggagcgtcctcaaaaaacaccagcccacacgttgacgtcggcacctcctgcaagatgagccgggcacatttattaagcagccgtttggctggaaaaaatggccaatgcaactcggtctgaatttctctcctgggtgtccaaggatcaaggcaggtaatgaggttggcagaattatgaatcgcaatcaaattttttctatgacctgatagaaacgccaactcactgtatgagtctgttgtcaaagtctaacttccaaaacgcaaagcacgctcccgatcataaacacagagatagcagtattgaagaattgtccccccggctccagccccggatttctctagaggggctaatggaggccacgacatttgtggcataaaaaggtttgcgatgaacagtcttgcctggggtgcaggaaggtgaggagctgtgtgtggcttttgcgttttccttcacgatggaatgcgagtctttgatgccggctagatccacgttttatgaggcggaatttttaatattgaaagtcagaaagggctagatggtctttggagtcccagtgggtgaagtcgaagtaaaggaatgtggtcattaaaaaaaaaaaaaaaaaacttgatttttcttacccagaggttggtacacggtgagtctaattttctcaaaggaaatctgaaatcagaccaatttggagtgtcgttagctgggatctacctccaacgggcccacatcaccaaccctcatgtcgggcaccgaatttccgtcactattctgcaggatgagctcacgccaggaatacctccaccaacccaatgtctgactcaaaactttgcaaactaggaaaggcccaaagaaattatgaaatcagggccgggcgcggtgcctcacgcctgtcatcccagcactttgggaggccgaggcaggtggatcagcagatcaggagatcaagactgtcctggctaacatggtgaaaccccgtctctactaaaaatacaaacaattagccgggcgcggtggtgagcacctgtagtaccagctactcgggaggctgaggcaggagaatggcgtggtggctcacacctgtaatcccagcactttgggaggccgaggcaggtggatctcttgaactcaggagatcaagaccagcctgggcaacatggggaaaccccgtctctactaaaaatacaaaaattagatgggtgtggtggtgggtgcctgtaatcccagctactccaggggactgaggtgggaggattgcttgagcccgggaggcggaggttgcagtgagcagaaattgcaccactgcactccagcctgggtgacagagtgagactctgtctcaaaaatgaaaaaaaaaaaaaaaagaggtggggtgcagtggctcacacctgtaatcccagcactttgggaggccgaggcgggtggatcacgaggtcgggagatccagaccagcctgaccaacatggtgaaaccctgtctctactaaaaatacaaaaattagctgggagtgatggcgggtgcctgtggtcccagctactcaggaggctgaggcaagagaatcgcttgaagttgggagtcagaggttgcagtgagccgagatggcaccactgcactccagcatgggcgactgagtgagactccgtctcaaaaaaaaaaaaaagaaagaaagaaaaaagaaagaaagcgaaagaagaaggaaagaaagaaagcgaaagaagaaggaaagaaagagaaaggagaaagacagagaaagaaggaaaaatgaaagaaagaagaaagagaaagaaagaaagaaagaaagaaagaaagaaagaaagaaagaaagaaagaaaagaagaaagaaagaaagagaaagaaagaaagaaagaagaaagaaagaaagaagaaagagaaagaaaggaagaaagggctgggcacagtggctcacgcctgtaatcccagcactttgggaggctgaggcgggtggatcctctgaggtcaggagatcgaggccagcctgaccaacatggagaaaccccgtctctactaaaaatacaaaaattagccgggcgtggtggtgcatgcttgtaatcccagctactcgggaggctgaggcaggagcatcgcttgaacccaggaggcagaggttgccgtcagccgacgtcatgccaatgcactccagcctgggcaacaaaagcaaaactccgtctcaaagaaaaaagaaagaaaaaaaaaagaaaatcagagactccctggcagatctcagggtatgactcccccagggtcgccatagctgactgcattagcacggccctgtgatcaccggatgaatggtcttggtgggacaggtggctgccgtgatcaaacggcgtgtccgccggtgctgacaggtgaggtgcggagttgcccacatggcccgcctgggcctggtccaccagcagcagggaaggaggagcagagcccagctcggtgcatttggaggcggttaccagggaaaccagaggacaagctcagacgcttggggacggcctctccacccaggcacgtggagcttcatattaatcggcagccgggcacgggctggcagccccttacccagacagatacacacagaagtggagctcccagtgatggctcgtcacggctgatatctgccccagtggtcatgttgaaccgggacgtcatctctgtaggaaaagggggacggatgtctgtctggacacggtccaaggtacatcgctgtctgatctttccgaaaagtcagcgttcgtggcttgagctggacgctttgaaaggcgagggcgtcggaagcttcatctcagggagctgtcatgtggtattagcttgtagcaccaccaacctgccctgcccagactgacttctccagggcgggttttccaggaggaagcgcagggtgactctgtttccccagcggcttccaagcactcctggggacctctgtttgtgagaaggacaacatctgtgtctgtctgatgggcttggtgggatactctgatgcatgcacctgccgccggagctctctctgcaaacgttctgtgctgacttaggggaggcaaagacacagagttggagatcaaggctggtttgttcttcagccttttgactcttcatctgcggcatcattgcatctgtttgaatatttttcaaaaagtttatcgaaaacacagctgcactccgacgaagatccccacactattcacaatgggaaacatatataatcgaccgacgtgtgtttcatttgcttttccctgatgattattgattgtcttagtccgttttcatgctgctgataaagatacaaccgaggctggggacggtggctcacgcctgtcgtcccagcactttaggaggctgaggtgggtggatcacctgaggtcaggagtttgagaccatcctggccaacatggtgaaactgtctctactaaaaatacaaaaattagctgagcgtagtagcagacgcctgtaatcccagcactttgggaggccgaggcacgcagatcacctgaggtcaggagtttgagaccagcctggccaacatggtaaaacccgtctctactgaaaatataaaacttagccaggcttggtggtgcgtgcctgtaatcccagctactcaggaggctgaggcaggagaatcgcttgaacccgggaggcggaggttgcagtgagccaagatcacgacactgcactccagcctgggcgacagagcgagactccatctcaaaaataaaagaaaaaaagagacatacccaagagtgggtaatttataaaaaagaaagaaaaagaggttgaatggactcacggttccttcccaaaagctcactgtacaaacacaaagtggggaataggtctttaaagcatcgaaagtgagcaggctcgatcactacaaattttttgtttgtttctttcttttgagacaaggtcttactccatcacccaggctggagtgcagtggcacgatctcggctcactgcaacctccgcctcccgggttcaagcgattctcctgcctcagcctcccgagtagctggggctacaggcgcccaccaccacgcctggctaatttcttgtgtttttaatagagatggggtttcactatgttgaccaggctggtctcgatctcctgacctcatgatctgcccacctcagcctcccaaagtgctgggattacagacgtgagccactgcacccggcctaatgtttgtattttcagtagagatgatgtttcactgtgttgggcaggctggtctcgaactcctgacctcaggtgatccacctgcttcggcctcccaaagtgctgggactacaggcgcccaccacacgcccagctaatttcttgtatttttaatagagacggggtttcactatgttggccaggctggtttcgatctcctgacctcatgatctgcccgcctcagcctcccaaagtgctgggattacaagcgtgagccactgcacccggcctaacgtttgtattttcagtagagatgatgtttcactgtgttgggcaggctggtctcgaactcctgacctcaggtgatccgcctgctttggcctcccaaagtgctgggactacaggcgcccgccacatgcccagctaatttcttgtatttttaatagagacggggtttcactatgttggccaggctggtctcgatctcctgacctcacgatctgcccgcctcagcctcccaaagtgttgggattacaggcgtgagccacctcgcccagcctaaatgttttttggttgcatggatggtttggtaaagtctaggctgctagcacacctgtgcactgagtagcatacattgaaccccagaggtaatttttcatgcctcactctgctcctatcttcccgtcttctgagtctccaatgtccactattctaccctgtatgtccccgggtacccagaacgtagtgtcttcttataaatgacaacatgtggtattttttttctgttcctgagttactctagttaggaaagtcatcttcagctccatccaagttgctgcaaattacattatcttgttctttttcatggctgagtagtattccatggtgtatataaaccacattttcattttcttttcttttcttttttttttttttttttttgagatggagtctcgctctgttgcccaggctggagtgcagtggtgcaatctcggctcactgcaacatccgcctcccgggttcaaacatttctcctgcttcagccttccgagtagctgggatgacaggcagccgccaccatgcccagctcattgttttgttttgttttttctatttcttgtatttttaatagagtcagggtttcaccatgttggccaggctggtcttgaactcctgacctcaggtgatccacccgcctcggcctctcacagtgctgggatgacaagtctgagccatctcacacctgtttcttttccttcttaatgggcatgtaaaattgttctgcaacactcctggctcttctgtggaagtgtgatgtccacgagaaggaatttagggagagcaagcttgcttctgcagtccccgggaaaggcaggtctgcatggctagcggggtcaagctctcgtaggaaggaaagaatgctccaagacatgctctgaacccaggaagaacgcaagcttcggctccgaagcgttccgaggaggccaagctgcctctaatcaccccgaattatccgtaaggggaggcgtcggggagctggtaatccgtggggatggaagctaattacttaatcactcgcatttgtaaatcgcattattggaaaagaaattactctggtgatcgaattacagatatttatctgctaatagccctgattaactggcgatgttaatctgtcattttgaaagctaatattaacagcatcaatctcgccgagaaaataaacagtttacgggaaataaaaccgggtgtaatggaaagcaccgtgtgtcggagtccccagatctagagtgtgctgctgagtgcagtggccaaggtccccccgttagccctttatggaaaataccctctggctgggaacggttcggacgaggctgactctaacgggctcagagaagctgaggagaaacacccggggaaaatgcattttgagaaaaatcccaaaggttctagacacgggtcccccagggaacgccctgcacgtgtatttatgcagagttcactctcgataaaaaggatcccctggaattccaagcaaggaaggattgagctatccagcagacacccggtgggtgcattttacgtcgcctttagccaaatcgatgatctcagagtgagactcagagtgaggctccggctcaaagaaaaaaaaaaaaaattaccaaatagtgtcaaaaccatagctatgtcttttctcagacaacaatttgataatgcttctttttggaaaattagcaagatttgaggatggggtttggatttgctcaagaacagtatgatggcaggatctggacctttagcaaaacccccctctactaaaaattataaaaattagccaggcgtggtggtgggtgcctgtaattccagctactagggaggctgaggcaggagaatcgcttgaatgagagtcgattggctgtaaatgtaaaggaatctgccacaatctgaaagccgtgggctgaacggtgtctctcctggaaagcgtgttgcaatccagactccagtgaacgtaacttgatttgcaacagggtctttgatttggaaagttaacatgatatccgtagggtgggccctgattcaatgggactggtgtctttataagaagaggacatgagccgggcacggtggctgacgcctgtaatccgagcagtttgggaggctgaggctggggg

SEQ ID NO: 1395 - DNA, 1100 bp, artificial
  synthetic oligo
tactaaaaatacacaaattagccgggcgtggtggtgggcgactgtaatcccagctactcgggaggctgagggaggagaatcgcttgaacccgggaggcagaggttgcagtgagccgagatcgcaccactgcattccaacctggatgagagagcgagactctgtctcaaaaaacaaaagtatttcaccctccttctttcatacaacaggagaaatactttttcctcctgcctctgcctttttgggggggacaatttcaatgagattcagtgaaagtcgttggtgaatggctttaacttactgtaatttatttcatgcagttccattaacttgggtctgttgaagcttgtgtacgtgaaaatgaaaccggtcgtgagctttgaaaatccacagagttttacatgaaagtggtcttttacctgaaagcacactcatcgactccgtgcagtcttggaatctgggattccctttgaaggtaatacccacaattatttgtgtttcataaatatggaattacgcgttcatactcctggttattaactgggatatggcttttaaatctaactgttagtcattgaaatcctttgctgaataaattgaatcagtttctagaaggtggatacggttgtttcatgtcttttcagggtagaaccatatgcagttgagtatccccgtctgtggagagttggaaaaggctggggaaagtctgaagcctttgctggaccttgattttgtccttctgtcttctcctttgtgcacttacgctgggaaataacatctttgctaataacgtcagaagagagtgcagaagccgggcgcggtggctcacgcctgtcatcccagcactttgggaggccggggtggaccgatctcgaggtcaggagttcgagaccagcctggccaacatggtgaaaccccgtctctactaaaaacccaaaaactagccgggcgtggtggcgcatgcctgtagtcccagctactcgggagactgaggcaggagaattgcttgaacctgggaggtggaggttgcagtgagccaagatcgcaccactgcactccagcctgggagacgagagactctgtctcaaagaaaaaaaaaaaa

SEQ ID NO: 1396 - DNA, 1200 bp, artificial
  synthetic oligo
tgcctggctaatttttgtatttttagtagagatggggtttcactgtgttggccaggctggtctcgaactcctgaccacaggtgatccacccgacttggcctcccaaagtgctgggattataggcgtgtgccaccgcgcccggcctaatatcactttcagtcaacattatcccctgacttgacgatgtccagggctggcacaagcttctaacttttctgtgtacctttggtaacagttaccgtgaaactctgactctcccatgtaggaagccgatatccatgctaccgctgaaccctctccatcccacctgtggtcaaccctctctccatcttatagccagtttccatcatccccatttacaaagctaccctgggtttccctctgttttccctcgccgtgaaatatcaagttaggaaaacctcgctggaaaatctcagggaacaatgtaggaagtcagatttcacgtctgaaatcggggaaaaatggagacagctacggtgcttttccatgagtgataatttccttttctacccctcccttgttccctggcagttgggtttacgatcggcggcagacggatggctttttatgagtttcgtatttttcataaggccacacttcattattcgtatgttgggatgtcttctgcttgcgttctaaatcatgctgcgaaataaacttaaacgagagagaacatgataagcaccgtattgtttgttttttattttgttttgttctgtttttgtttttgcttttgttttctgctccctgtttgcaaataaagagaattgccaaacttgattaaaagttggtagttaaggctgggcacggtggctcacatctatataatcccagcactttgggaggccgaggcgggcggatcacctgaggtcaggagttcgagaccagcctggccaacatagtgaaaccccgtctctactaaaaatacaaaattagccaggcgtggtggtgggcacctgtaatcccagttactcgggaggctgaggcgggagaatcacttgaacccgggagacggaagttgcagtgagccgagatcgcaccactgcactccagcctgggcaatgagagcaaaaactcttgtctcaaaaaaaaaaaaaaaaaaaaaaaaagaaagaaagaaaggaaaaaagaaaagaaaagaaaaaaagaaaagatcagatcagcccacagttttatttt

SEQ ID NO: 1397 - DNA, 3050 bp, artificial
  synthetic oligo
tttctccttgactcactcggcttctagagttccacaccctctctgtcttcctcctacccctctggcaacttctctccagttgcgttagtctattctcacaccgctaataaagacatatctgaagccgggtgcggtggctcacgtctgtcatcccagcactttgggaggccgaggcgggcggatcacgaggtcgggagatcgagaccatcctggctaacacggtgaaacctcgtctctactaaaaatacaaaaaattatttttgggaggcccacctcggcctcccaaagtgctgggatgacaggcgtgagccaccgcgcctggccccatatcaccagatagaatgttctagaacgtttttccggaaagatgtagtcagccacaaactcacttcttctccctgagccacccccctccttttaagaggcaaactgtccactgcctcgctggctttgaccccgaatactttttctcatttccatcaacataccggttttctcacacactatgtaattttcttgtttatttcagagttccttctctctctgatgaaggggtacgtttcaccaggacgggggtcttggttttgtcctctccaaacagtgcctgacgtatgacatgtgcatttacgggatgaaggagggaaacttcaaaccctcccgggtaccacctttgaagctgtcggaaagcgctttggtgacccccatctctttggcacagagcatttcgccccttgtcagcctcatgctatcaacattccttgcccgactgtctttcgtttctgcgtaggtgatatatgagcccgtgctgttccctgcctctttcaacctattaaattgctttcacttctaatgagagacagaggttttcctgcttcacagagcctcgtaagcatctgcttgcagacctgagacctgatgaggtgctaataaaatccagcagaggatgtggcacccaccagcatttctgcgtcacatttgtgtaatgtatggctctaatctgaccaggttttcatgaggagctttggaggaatgtgtctcagcaccctgaacactctgcagttacctccgctccggggaccaaggcctgtgtctcattcccgagcatcatccgtgtaggaatggcctgcccgcctagctcagaaaaggaagcctgccctggctgcttgtttttgaaagtgtgatcgtctccctgctgcttggtttgccttctttttcttttttggttttttgagacagagattcgctcttgttaccaaggctggagtgcactggtgcgatctcggctcacagcaacctccgcctcccgggttcaagcgattctcctgcctcagcctcccgagtagctgggactacaggcacccaccaccatgcccggctaattttgtaatttttgtacagacggagtctcaccatgttgaccaggctgctctcgaactcctgacctcaggtgatccacccgcctcggcctcccaaagtgctgggattacaggcgtcagccactgtaccggccttttgttgttgctgttttgtttttttgtttgtctgtttgtttttatttttggctgtgtttgagacagagtcttgctctatcacccagactggagtgcagcagcgcgatctcggctcactgcaacctctacctcccgggcttaagcgagcctcctgcctcagcctcccgagtagctgggatgacaggcatgcaccaccacacccgggtaattttgtatttttagtagagatggggtttcaccatgttggccaggctggtctcgaactcccgacctcaggtgatccaccctcctcaacctcacaaagtggagggattacaggcatgagccaccatgccgggctgtgtttcttaattaatgtctgtacgttgtttttttaacatagcggtattgcacacataccagactacagtctaagcaaggtgtatacgcagtaggaaagtaaaactgtgtatgactcgctttattgggacatgagctttatagggatggtctctgcacatcaatttgcactttctccaaggcacgcctggatggggtgatatccacgtctgcgtccttaaaatgagggacggtcatctactttcgacgatttcctttgctgagctttgccgagcaccgtgacaaatcagctgagctcgcagacacaccatgggtaagtaggagatgattgtcatccaagggctaagttaatcccctctttcatatttaccttacacttaccagctcccactttaaggtccattaaaataaagctctctgagtccccagagaaacggctctcaccagtgagcccgaggggaaaacgtgtcagtcaagctattattggtgctaattagctgctgtgccggctgagagaaagcacggctgcagacacgtgtcagtcagagaggcatctttctccccgccttggcacgcatctctgcctttttgccatcttctgcctttggtcatcttctgcctttggtcatcttctgcctttttgccatcacggaaactgtctccaaactaagcaaacaggtctcagggatcaacaggaatgatatccaccctcctgagggttcctttgctcctggatcttgaatactcccagagacccccaactgtaggccaaaagccgatgccaggtctgcagaggaggcccctgtgaaaatggccagctgataactattattacgttgctttttttcatttggaaagtctgtgggagtgtccccgagtttaagtcaggaaggaacatttaaaaacagaatcttccggccgggcacggtggctcacgcctgtcatcccagcactttgggaggccgaggcgggtggatcacctgaggtcaggagatcgagaccagcctggccaacatgtgtgaaaccccgtctctactaaaaatacaaaaaattagccaggcgtggtggcgggcgcctgtagtcccagctactcgggaagctgaggcaggagaatcgcttgaacccgggacgtggaggttgcagagagctgagatcgcaccactgcactccagcctgggcaagactccgtctgaaaaataa

SEQ ID NO: 1398 - DNA, 1900 bp, artificial
  synthetic oligo
tgagccaccgcgccccgcctttaattcattcccttaaatcacagtctcccggggtcatctggtctccccactgggggcagattcaatccccaaccagtgtgcgtgtaagagggaacttcctggaaggccggtttcttcccacttggagtgaggagctgggcaccgggctctagtggccaatggtccatgagcttgattttcagaacttaactgaaagtaactgaaggtaaggagatgaaggggtactgaaaagtgtgctgggattgcttttcaatcgttacggtaatcattgatcccgcgacttgcgagagcttgcttttcggtacttatgataatcagctgaaggaagtactgaaaagcatgctgagcttgcttttcaattgttatggtaatcattgatcccgcgacttgcgagagcttgcttttcagtacttatggtaataagctgaaggaaatactgaaaagcatgttgagcttgcttttcaatagttacggtaatcatggatccggttatttgcatgagcttttttatttatggcaataagctgaaggaagtagtgaaaaggatgctgggctgcttttcaatagttacgggaatctgatcctgcgacttgctagagcttgcttttcagtacttatggtaataagctgaaggaagtactgaaaagcatggtgagcttgcttttcaatagctacggtaatcactgatccagtgacttgcatgagcttgctttatcagtacttatggtaataagctgaaggaagtacgaaaagcatggtgagcttgcttttcaatagttatggtaatcatggatccggtaatttgcatgagcttttcagtacttatggtaataacctgaaggaagtagcgaaaagtaggctgggttgcttttcagtggttacggtaatcattgatccagcgactatcatgagattgcttttcggtacttacggtaatcagctgaaggaagtagtgaaaagcgtgctgagcttgcttttcaattattacggtaatcatggatccgacgatttacgtgagcttttcagtacttacggtaataagctgaaggaagtactgaaaactatgctgagcttccttttcaatagttacgggaatcattgatcccgcgactggctggagcttggtttttcgttacttacagtaataagctgcaggaagtactgaaaggcatggtgagcttgcttctcaatagttaacggtaatcatggatccggcgatttgcatgagcttggttttcagtccttgtggtaataagctgaaggaagtactgaaaagcatggtgagctggctttacaatacttacggtaataaaccatccagcgacttgcggtgaaaacggggtgcgtcccattcctgatggagaaatagagaatgtcgtctcgctgctctgcgtctaggaggcaccccgaagtgtgaccttcctggagaaggtagttggtgcactggtcataggcctcatcaccgttgaatctgtggtttaaaacgatgaccattcagcaacaaaacaaaaaagcatgtcttatttatttagagatggggtcttgctcttgtcgcccaggttggagtgcaatggcgcgatctcagctcactgcaacctctgcctcccgggttcaagcaattctcctgtctcagcctcctgagtagctgggattacaggcacctgccaccatatacagctaatttttgtagttttactggagacagggtttcaccatgttggggccaggctggtctggaactcctgacctcaggtgatccatacaccttggcctcccaaactgctggaatgagaggtgtgagctaccacaccggctttttttttttttttttttttaagatggtgtctcgctctgtccctgaggctggagtgcagtggca

SEQ ID NO: 1399 - DNA, 1700 bp, artificial
  synthetic oligo
tgaacctgggaggtggagtttgcagtgagctgagatcgcgccactgcactccagcctgggcgatagagcgagcctccatctcaaaaaaaaaagagttctttgttgctgttgtaagttctgtgcgtttggacaaacatatagtgacgttggatggaccattatacgatcaaatggaggagtttcactgctctaaaaatcccctgagttctacctgttcattcctccctgcctgacacctctggccacccctgatcatcttactgtctgcataagtttgctttctttttcttttcttttcttttcttttttttttttgacacagagtctcactctgtctcccacgttggagtgcagtcgcgtgatctgggttcactgcaagctttgcctcccaggttcaagcgattctcctgcctcagcctcccgagtagctgagatgacaggtgcccgccaccaagcccggctgattttgtgttttctgtagagacgaggtttccccatgtcggccaggctggtcttgaactcccgacttcaggtgatccacccacctcggcctcccaaagtgttgggatgacaggcgtgagccaccgtgcccggacagttttgccttttctagaatgtcttatagttgcagccatagtctgtagccatctcagactgactttcttttttcattcaatggttttttgtttgtttgtctttttgtttgtagagaagttcaggtttaaagaaaaactgagcaggggccgggcgtggcggctcacgcctgtgatcccaggactttgggaggccgaggcaggtggatcacctgaggtcaggagttggagaccagcctggccaaaatcactaagctaaagagaaaattcaagctaggaggtgctcagggcaaatctgcctccgtttctataaaaagtcaaccctgtggtcatggagatagatgcatattctgattgcctgctttcgagaggcttatcagaaactcagaggaatacagccatcggtctctcacctacctcggacctgggagccccctgcttgctttaagtcatccctgcctttctgcacagaaccagtgtacttcttacatatattaattcacatctcatgtctccttaaaatgcataaaacaaaggccgggcgcggaggctcacgcctgtcatcccagcactttgggaggccgaggcgggtgggtcacctaaggttaggagttcaagaccagcctggccaacatggtgaaaccctgtctctactaaaaatacaaaaaaaaaaaaaaaaattagccaaatgtagtggcaggtgcctgtaatcccagctactcgggaggctgaggcaggagaatcgcctgaacccagaaggcggaggtcgcagtgagccgagaccgcggcactgcactccagcctgggtgacagagtgagactccgtctcaaaaaaaaaaaaaaaatgcatacaatgaactgggcgcagtggcccacgcctgtcatcccagcgctttggaaggttgagccaggcagatcacctgaggtcaagagtttgagaacagcctggtcaacagtgtgaacctagtgtctactaaaaatacaaaaactagccaaaagtggtggcgggcgcctgtagtcccagctactcgggaggctgaggcaggagaatcgcttgaaccctggaggcggaggttgcagtgagcggagatcacgccactgcactcc

SEQ ID NO: 1400 - DNA, 1600 bp, artificial
  synthetic oligo
cgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaaca

SEQ ID NO: 1401 - DNA, 1250 bp, artificial
  synthetic oligo
cgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtgga

SEQ ID NO: 1402 - DNA, 1350 bp, artificial
  synthetic oligo
ggcatggtggcgagtgcctgtaatcccagctactcaggaggctgaggcaggagagtcgcttgaacctgggaggcagaggttgcaatgagccgagatcatgccactgcactccagcctggacgacaagggcgagtctccatcaggaaaaaaaaaaaaagaaaacacacaaacacttatgtgtgcacacagatacacacgggcacaaaaatgtacacacgtgcaagcacacacacacacagacacatgtacacagtacccgtgtgtgcacaggcatgcatgcagtcctgcaaatgtgcaaacagacatggctacatagaggcatgcacacatatagacccatgtacacacacacgaatattcgtgcacacatgtagaagcacactctgatgtgcatgcatgtgcaaaggcgcatttgcacacagacacatatgcacactcaccaccgctttccctccagaagcagctccttctgctgtgagcaccaggctctggaaggggcaagcatccttcattacccgcaacccagtttcacagccagtccccgctgcctgactctcgtttctcctgcagcaggcacctctgtcctgcgttccggagctgcgttcccgatggtcctcctttggctcacgctgctcctgatcgccctgccctgtctcctgcaaacgaaggaaggtaagaactggagaaaaaatgcacgtgccacctggggagcggtgggggtagacagacacacaatgtcagcgtgccgtccttcagggaaacttttcatgctgagctcatggcagagtctcatgcagtggtcgggaatgactcagacacttccctgtacccgtcaccaagttccctgtaatgcagcatcttgcaaaacggtaatacgacctcacaggcagggacctgatcgtgacacagatgccatgtgaggtgttttgatgaaactcacacgctgggatcaacagcaccaataacaatttccagtttccttcattgtttatcttactttttcattttcttattatttttattttggagacagggtcttactgtcttgcccaggctggagtgcaatagtgtgatctcggctcactgcaacctctgcctcccggattcaagcgattcttctgcctcagcctcccgaggagctgagattacagtcgcgcaccaccatacccggctaatttctgtatttttgatagagacgggatttcactatgtcggtcaggctggtctagaactgctgaccacaagtgatccgtctgccttggcctcccaaagtgctgggattacaggtgtgagccacagcgcccggccttttttttcattggtttttacagtctattactgcagggtttc

SEQ ID NO: 1403 - DNA, 3350 bp, artificial
  synthetic oligo
gggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctca

SEQ ID NO: 1404 - DNA, 2400 bp, artificial
  synthetic oligo
gagcaacagatctctgttgtttctttctgttttcttttttttttttttgagacagagtcttcctctgtcgcccaggctggagtgcagtggcacgatctcagcttactgcaagctccgccttccaggtttacgccattctcctgcctcagcctcctgagtagctgggactacaggcgcccgccaccatccccggctaattttttgtattttttatttttagtagagacggggtttcaccgtgttagccaggatggtctcgatctcctgacctcgtgatctgccagcctcgacctcccaaagtgctgggatgacaggcgtgagccactgcgcctggcaaatgtctgttgtttctaagccaccgaggctatggtattctgctatagcaacgcaaacggactaagacatcatcctgaaacatgaaacttccagccccagggaatgggtgaaagatgtttacttactcaaggtttgtaacccgccacaactcccatgatgaaatcctcagtccccaaggcaatggtatttggaggtgaggactttgggaggtgatgaggtcatgcaggtggagtgttatgagtaggatttgtgcccttataaaagggaccccaggccgggtgcggtggctcacgcctgtcatcccagcactttgggaggccgaggcgggcggatcacgaggtcaggagttccacagcagcctggccaacatggtgaaaccccatctctacaaaaaaatacaacaattagccagggccaggagtggtggtgggtgcctgcaatcccagctcctcgggaggctgacgctcacgcctgtcatcccagcactttgggaggctgaggtgggtggatcacaaggtcgggagtttgagagcagcctggccaacatggcgaaaccccatctctactaaaaatacaaaaaacattagcggggcatggtggcgggcacctgtaatcccagctcctcgggaggctgaggcaggagaatcgcttgaacccgggaggcggaggttgcagtgagctgagatcgcgccactgcactccagcctcagtgacagagcgagactccatctcaaaaaacaaaaacaacaacaaaataaaataaaataaaatggaccccagagagctccctcaccccttccaacaccatgtgagacacagcaagaaggcgctgtctatagatcaggaagccactggttcatagaccaccagacactgaatctgccacaccttaaccttggacttccagcctccagaaccatgagacatagatgcctgctgttgagaaggcccccagcctatggtatttcacgatagcaacacatacgaactaagacactctcctgaaatatgaaggttccagccccagcaaatgagggaaaggaaagagtcatccacgtccagggagggtcagggttgaagctgatgctaccagggccctcttgagttggcgtttagggccagatgccgtgcgtagagaatgtgtacgggggaatggagacggccaccgtttctcatctgtgccgtaaagtcccaggcactcgggccgtcctgggacccagtgcctggcaaacatacttcaggatggctttcacgggaaccctgtgaaactctgccggggctgtgtagccaccgcctttcacttctcatgaggctttcctgagtaacccagttgtctctctggctgttggcagccctggggaggtctgttgttgactgcaaaggtggtacgggaagaggaagtaccacaccctccaactttctgcatcgcgaaccctatctgaccctcctcatctaggggtgctgtttttctgcagaagttggcactacagtcttgaagaaaacaaaacaaaacaaaacaccaaagtactggctacaggaagcccaggctaccaatttcatttccttataatctcagttctggggtcttgatttgaacatgatgctccagtgtcaggaaggggtcaaaaaagggaagcatgtctgtgaccttcaactcaggaggaaaacactttatggttgtttcttctttttaaattaaatctatcgagaggcagaaccactgaggaatatgcatagcagcacacaatagccgaaaggtggaaacaactcaaatatccatgcacacacgggagtggatatgcaggataaatccatgcaatggagtactacacagccatgcaatggaacactacgcagccatgaaaatgggatactatgcacccttgaaaaaggaatgaggttctgacgcaggctgccgcatggatgaaccttaggacatcatgctcagtgagagaagccagacacagaaggacacactttgtaggattccatttctatgaaatgtccagaacaggcagatccatacaaatagaaagtggatttgtggttgtgaggggctgggga

SEQ ID NO: 1405 - DNA, 1650 bp, artificial
  synthetic oligo
tgtttgagtactgggcaggcagcagggagagtcaggcagcagctgtgagcgggtggctcttccccaccttgccagcaggctctgtgctccttgaagcaagcgctccagaggctccggaagccacggctggattggagacaagatgggatcctcagaggaccaggcctatcgcctccttaatgactacgccaacggcttcatggtgtcccaggtaggatacgctctgtgggacaagggggaatagacttccgttcatcacactcacgttccattgttgtgtcagtcgagaaaaatgatgagtctccatcattttaggaggtttattttccaccgtgaaagacgtacacccacgatgtagcctcaggagttcctgaggacatgtgcccagggtggtctggggacagcttggtttgatacattttacagagacatgagtcatcaatcaatgtatgtaagtacattgggccagtcgtggtggctcacacctgtgatcccagcactttgggaggctgaggcgggcggatcacctgaggtcgggagttcgagaccagcctgacccacacagagaaaccccatctctactaaaaatacaaaattagccaggcttggtggtacatgcctataatcccagctacttgggaggctgaggcaggagaatcgcttgaacctgggaggcggaggttgcagtgagccgagatcgcaccactgcactcccgcctgggggacacagcaagactctgtgtcaaaaaaaaaccaaacaaacaacaaaaaaaaagaaacaaagcttaagatgaaatacataggattagaaacaagacaatgtttattgaactgcaagtgttgaaatttttaaaacatttcatgatagagtagtatatgtggttgtttattaacccagtaaataattacactgtgcgtttatcatagaggtgagttttgagggttcacccgtagaggagcaacacctcattccttttttttatttttttgagctggagtctcactctgtaacccaggctggagtgcagtggcacggtcttggctcactgcaacctccgcctccagggttcaggctattctcctgcttcagcctcccgagtatctgggattacaggcacccaccaccacgcccggctaatttttgtatttttagtagagatggggtttcaccatgttggccaggctggtctcgaactcctgacctcaagtgattcacctgcctcggcctcccaaggcctcatttcttcttctcacagaataacatcgtgctcagtgaaggaaggctgacgtgaaaggccccatatggtatgacttcatttatatgaaatgtgcagagcaggcaaatccttcgaggtggaaagtggactggtggtttgcagaggctgggcaggactgcggagggagtgtttaacggagacagtgtccctttttggggtgatgcaaatgttctggaacccggcggaagtgctggctatacaacatcacgaatgtactaagtgcccctgaattatgcttgaaaagggttaatgatggccgggctcagcggtgacacctgtcatcccaacggtttgggggtccgaaacgagggaatcgctttagcccaggaattcgagaccagtctgggcaacatagtgagaccccccatttcta

SEQ ID NO: 1406 - DNA, 1950 bp, artificial
  synthetic oligo
tgatttggtcagaggtgaaggtgaggccaggtgagacctcagctcttcactttgctttgcgatgtggacacagctttggcctttgcccgaagctcttacctagaattcccagatggaggtgaattgatgggcccgtccagtgttccagctggctgaggcatggagtagggaagggtatgaaggacaaggggatgcctgagtggttcgcctgccccccaacctctcctctcctcccctgctctcccctcccctctcttctccttctgtcctgttccctctcttttcctcttccatcctcctctctttctctccttttccttctcttctcttctctcctctcttttcctctccatcttccccctcctctctcccatcttccctctcttgtctcctctctcttcttccctctctcctttcctctcgcctcccttcccctcccttcacctgcctctctccttctcctctcccgtcttctttctctcatcttctctgttttcatgccccgtatttcacctccttttctcctcctctcttctcctcggtctgctttcctttcccccgtttctctctttctttctctctctctttctttctttccttctttctttccttctttctccttccttccttcgttccttcctctttccttctgcctgccttccttccttccctccctccctcctttctttctttttctttcttccttcttccttctttcctttctttatatatatatatatgtgtgtatacatgtgtatgtgtatgtgaatatatgtatctgtttagggggcacaagtacccatgtcttccatgcttacatgttgcaccttgcagcctaggcttttagtgtgcccatcacctgaatagtgaccgtggtacctaagaggcaatttttcagccctcgctactctgaggcaaacccctacagcaggctctgcagagaggacaggaggagagagggagctgtggggggggaggagcaggaaatgcttccaacaccagagccctgtccgcctctgtgtccacctatccttcttggctccatctcacctgcctcccttcctagttcctgccttttctctagcctcttccccaggatgtgtggacctcccacccgcttcctggatttgtcctctggggctgagctctgtggatgggggaacgtattattgactttcctcttagaaaacatctaaactcctcttcagatagaaatcccttcccatccagagaacaatcgtccgttctgaatcaactccaggtttcccggagctgggtacactttgctggctgacctatggttcccccatcccgaatgacttcctgttccatttcacaaatgcaagccttccaggtgcacctgtggggtatagctccgttctcaacagggggttatgtacacccttgctctgggcacgtccccagatcctcaccatcttgacaagcgtggttttgcatgccaggtccgagggcgagcggctacagttcatgcaagctctgcaggaggtctggagcgtcaacgggagaagcgtgctgaccgcctttgacctgtcagtgttcccacttatgtgtgaccttggtggtaagtacccctcaccactaatacctcggaggtgtggcttctgttctgtatggggaatgtgttattcatgtcttttattttctgcattctgatgctttgacatgtgcggccttactggtcttagaggaatcattcctcccagcactgggcacttcctagagtcagcaaacatctcctctgcgagcacacgtttctttttcttttctttttttaagatggaagcttgctccatcgcccaggctgcagtgcagtggcatgatctcggctcactgcaacctttgcctcctgggttcaagcgattctcctgcctcagcctcccgagtagctgggattacaggcacctgccaccacaccaggctaattttttt

SEQ ID NO: 1407 - DNA, 2400 bp, artificial
  synthetic oligo
aatgggatcagtgtccttataaaagggaccccagagagctccctcgccccttccacgcagagaaaatgcatcatctatgaaccaggaagtgggtccccaccagacactgaatccgccacgatcttaaacctccaacctttagaactgtgagtgacaaatgtctgtagtttataaattacccaactgaaggtattttattttagcagctccctactcaggaggctgtggcaggagaatcgcttgaacccgggaggcggagggtgcagtgagctgagatcacagcactgcactccagcctgggcaatacagcaagactccatctttaaaaaaaaaaaaaaaaaagttgcatcaagaatgaaaggtgcacaaaggcagccagggatgcaagccccttccaccctgggccctggaactgcacaggccaccttcaaaggtttctttcctgtcatcctcccaagtctacacgaatataaagaaacacactagaagcctctgataggatgggggcatctccagaaatccgaagattcaggttctgaacctctgatctgggtggggctgggagctgcagttccagaaagcaaatgaagccttggctgtgattcagaccatttcttggtagcaagcgtgtaggggaagaagaatgtggacggggcaggggaaggaatgaattcggtcaggacggtggctggagaatgtctgagacggccacgtgcagagaggagcaggctggctgcgtctctcactgtgcctgggacaggcggtgacagagaaatgggattccacatgagagtcagagacacccagtgaagaaacaaaagcagcttacagggtgaaaaggacacagacagacactgacactcagaagaatgttgccaagggaccgccactgtgtatgaactgaaaaggttccctaagaatgcggccaagggactgctgccgtgtacacactgaagacgctccctaagaatgcaactaaaagacaacactgaagacgttccctaggcatgtggctaagaaaccactgccatgtacacattgaagacattccctaagtatgtggctaaggcaccactgccatgtacacactgaagacgttccctaagtatgtggttaagggactgccgccatatacacactgaagatgttcactaagcaggtgactaagggatcgccgccatgtactcactgaagacgttcactaagcatacggccaagggactgccgccgtgtacacactgaagacattccctaagaatgtggctaagggaccgccgccatgtacacactgaagatgttcccaaaaaatgtggccaagggactgctgccatgtgcacattgaagacgttccctaagcaggtggctaagggaccaccaccatgtacacactgaagacgttccctaagaatgcagccaagggacggcactgaagacgttccctaggcatgtggtcaagggaccgcactgaagatgttccctaagcatgtagccaagggactgccaccgtgtacacattgaagacattccctacgaatgtggataagggacctccgccatgtacacactgaagacgttccctaaccatgcgcccaagggacctccgccatgtacacagtgaagacgttcccgaagaatgtggccaagagaccaccatgtacacactgaagatgttccctaagcatgtggccaatggaccgcactgatgacgttccctacgcatgcggccaacggactgccactgtgtacgcgcggaagacattccctaataatgtggctaagggaccactgccaagtacacactgaatatgttccctgagcatgtggccaagggacggccgtcatgtacacattgaagacgttccctaagaatgtggccaagggaccaccaccttgtacacagtgaagacgttccaaaggtccagtcatgggcctgcgaaacatcagaggaaagaatggtgtacaggatctagtcatcccaccactgggtgtgtacccatcaatgggatacctgccccactgtgcactgcagcactactcagtttccaagagacggaataaacccatgtgtcaatcaacagatgagtgcatcaaacaaatgtggcatagacacacactggaatagtatggagccatgaaaaaggaaatcctgtcatttgcagcaacatggatgggactggaagatacaaggtgaagtgaaatgaaacaggcacagagagacaaataccatatcatcgcatatgtagaatataaaaaagctgaacacataaatgcagagggtacaatggttgttgccagcaaagaatgctgaagtgtttgtcaaagaacacaaaatttcagttgctggccaaaagcggtggctcatgtctggaatcacaatgctatggaaggctgaggaaggag

SEQ ID NO: 1408 - DNA, 2100 bp, artificial
  synthetic oligo
cttcaaaaaaaaaaaaaaaaaacagctggatgaagaatgaaaggtgcacaaaggcagccagggatgcaagccccttccaccctgggccctggaactgcacaggccaccttctaaggtttctctcctgtcatcctcccaagtctacacgaatataaagaaacacactagaagtctctgatgggatgggggcatctccagaaatccgaagattcaggttctgaatctctgatctgagtgcggctggggagctgctgttccagaaagcaaatgaaactttggctgtgattcagaccatttcttggtagcaagggtgtagggaaagaaggatgtggaccgtgcaggagaaggaatgaatggggtcaggacagtggctggagaatgtctgagatggccacgtgcagagaggagcaggctggctgtgtctctcactgtgcctgggatgggtggtgacagatgagtgggattccacatgatagagacacccaatgaagaaataaaagcagcttacagggagcaaatgacacagacactcagaagaaagtggccaagggatcgtccccatgtatgaactgaagacgttttctaagaatgtggccaagggtccacactgaagatgatccctaagaatgtggccaagggaccaccaccatgtaggcactgaagacgttccctaagaatgtggcagcgggatggccactgtgtagaaactgaagatgttccctaaggatgtggccaagggaccaccaccatgtacacactgaagacgttccctaagtatgtggcgcaagggacctctgctgtgtgcacactgaagacgttccctaagcatgtggctaagggactgctaccatttacacactgaagacattccctaagatgcagccaagggacagcactcaagacattccctaggcatgtggccaagggaccgccaccatgtaaacactgaagacgttccctaagcctgtggctaagggacagccgccatgtacacactgaagacatcccctaagaatgccgcaaaagaaccgccaccgtggacatgctgaagatggttcccctaagcatgtggttaaaggactgccgccctgtacacactgaagacgttccctaagaatgtggccaagggactgccaccatgtacacactgaagacgttccctaagcatgtggcccaagggacagccacggtgtgcacactgaagacgttccctaagcttgtggctaagggaccaccaccatgtacacactgaagacgttccctaagaaagcagccaagagacggcagggaatatgttccgtaagcatgtagccaagggaccgccaccaagtacaaactgaagacattccctaagcttgtggctaagggaccaccgcagtgtgcacactgaagacgttccctaagaatgcggccaagggactgccgccatgtacacactaaagacattcccgaagaattaggactagggactgccaccgtgtacacactgaagacattcgggaagaatgtggctaagggactgctgccagctacacactgaagatgtttcctaagcatgtggtcaagagaccaacatcgtgtacacactgcagacgttccctaagaatgtggccaagggacccccaccttgtacaaagtgaagacgttccctaaggtccagccattggcctgcaaaacatcagagcaaagaatgttgtgcaggatccagtcatcccaccgctcggtgtgtacccaaaggaaaggaaatctgcccatcaatggcatacctgcaccccctgtgcactgcagcactactaatagtttccaagatatagaatcaacccatgttcaatcaacagataagtgcatcaagcgaatgtggcatagacacacaatggaatggtatgcagccatgaaaaaggaaatcctaccatttgcagcaacatgggtgggactgaaagatacaatgtgaagtgaaatgaaccaggcacagagagacaaatatcgtatcatctcataggtagaatctaaaaaagctgaacgcataaacgcagagagtgcaatggtggttgccagggaagaatgcttcatgaagtgtttggcaaagaacataacatttca

SEQ ID NO: 1409 - DNA, 2450 bp, artificial
  synthetic oligo
ttataaattacccaactgaaggtattttattttagcagctccctactcagagaggctgtggcaggagaatcgcttgaacatgggaggcggaggttgcagtgacctgagatcacaccactgcactccggcctgggcgacacagcaagactccgtctcaaaacaacaacaacaacggttggatcaagaatgaaaggtgcacgaaggcagtgatgaatggaagccccttccaccctgggctctggaactgcacaggccaccttctaaggttgctctcctgtcatcctcccaagtctacacggatataaagaaacacactagaggtctctgatgcgatgggggcatctccagaaatccgaagattcaggttctcaacctctgatctgggtgggggtggggagctgcaattccagaaagcaaaggaagccttggctgtgattcagaccatttcttggtatcaagcgtgtaggggaagaaggatgtggacaagggaaagagaaggaatgaatgcggtcaggacgctggctggagaatgtctgggatggtgacgtgcagagaggagcaggctggctgcgtctctcactgtgcctgggacaggcggtgacagaggaaagggattccacatgagagtcagagacacccaatgaagaaaaaaaagcagcttacagggtgaaaaggacacagacacagacacgcagaagaatgtggccaagggatcgccaccgagtacgaactgaagacgttttctaagaatgggtccaagggactgccactgtatgcactgaagacgttcggaaagcatgtggccaaaggaccactgctgtgtacacactgaagacattcgctaagaatatggctaagagacggccacctgtacacactggagacgttccctaagtatgtggctaagggaccaccgccatgtacacactgaagatgttccctaagtacgtggctaagggacggccgccatgtacgcactgaagacgctccctaagaatgcagcgaagagatggcagacgtttcctaggcatgtggctaagggaccgccgtgtacacacttaagacattccctaagcacgtggcccaagggaccattgccctttgcacattgaagacgatccctaagcttgggttaagggaccgctgccatgtacacactgaagaggttccctagcaatccggccaagggccgctgatgtgcacacactgaagacgttccctaagtgtgtggctaagggactgctaccatatacacactgaagatgttccctaagaatgtgggtaagggaccgccgccatgttcgcactgaagacgctccctaagaatgcgtccaggggactgctgccgtgtgcacactgaagatgttccctaagaatgtgggtaagggacccccgccatgttcgcactgaagacgctccctaagaatgcgtccaggggacagctgccgtgtgcacactgaagatgttccctaagtatgtggctaagggaaggcagccatgtacacactgaagacgttccctaagaatgcagccaagggagggcactgaagacgttccctaggcatgtggccaagggaccgccaccttatacacactgaagacgttccctaagcttacggctaagggaccgctgacatgtacacactgaagacgttctgtaacaatgcagccaaggaacggccaccatgtacacactgaagaattccctaagcatgtggcgcaagggactgataccatgtgcacaatgaagatgttccctaaccataggccaacagactgccactgtgtaaatacttaagacattccctaagaatggggctaagggacccccgccatgtacacactgaagacgttccctaagaatgcagtcacaggatggcaccgaagacgttccctaggcatatggccaagggacctcactgaagacgttccctaagcatgcggcccagggacagccaccgtgtacacactgaagacattcccaaagcatgtggccaagggaacaaactgaagacgttccctaatacaaaagctaagacattgtgggtgtaccacacacttcctacagctgtgggaaaatgaggctcttcagggcgcctccatgactagccacgaacccagctaggtgagccacggaaagaatggcgtgttgtaactgcagtaattaccaagacataacaggatctaatcgctttctaaatacatggctcccttaagtctccccatccctcctcaatcacgccaaagaagacctgtttagcatacaaaatcaagctgtgaggagtaaaactttggcaatgtcatttcatcacagcacagagccactgtgagtccagcacctcttatgaaaagaaaacagacggccaggcaccgtggctgacacctgtcatccgagcactttgggaggctgaggcaggtggatcacttgaggccaggagttcgaaaccagc

SEQ ID NO: 1410 - DNA, 2650 bp, artificial
  synthetic oligo
agaggcagccaggacacaagccccttccaccccgggccccggaaatgcacagaccaccttctaaggtttctctcctgtcatcctcccaagtctacacgaatatagagaaacacactagaagtctctgataggatgggggcatctccagaaatccaaagattcaggttctgaatctctgatctgggtggggctggggagctgcagtgccagaaagataatgaagccttggctgtgattcagaccatttcttggtatcaagcgtgtaggggaagaaggatgcggacagggcaggagaaggaatgaatgcggtcagcacggtggctggaggatgtctgggatggcgaggtgcagagaggagcaggctggctgcgtctctcactgtgcctgggatgggcggtgacagaggaaagggattccacatgagagtcagagacacccaatgaagaaacaaaagcagcttacagggtggaaaggacacagacacagacactcagaagaatgtggccaagggatcgccaccgtgtacgaactgaagacgttttctaagaatgtggacaagggactgccactccgtatgcactgaagaggttcccaaagcatgtggccaagggaccatcgccatgtacacaatcaagacaatccctaagcatgtgattaagggactgccaccatgtacacactgaagatgttccctaagaatggggccaagggaccactgccatgtacacactgaagacgttccctaagtatgtggctaagggaccgcccccatgtacgcactgaagacattccctaagaatgcagccaaaagacggcactgaagacgctccctaagaatgtggccaagggaccacaacggtgtacacactgaagccattccttaagcatgtggcccaagggactgccacgctgtgcatactgaagacgatccctaagcttgtggctaagggacggcggccatctacacaccaaagacgttccctaacaatgaggccaagggaccactgctgtgcacacactgaagatgttccctaagtgtgtggctaagggacctctgccatgtacacactgaagacgttccctaagaatgcagctaaaagatggcactgaagacgttccctaagcatgtggccaagagactgccaccatatacacactgaagacgttccctaagcttgtggctaagggaccgccgccatgtacacacttaagacgttccctaagaatgcggccaagggaccgccaccatgtacacactgaagacgttccctaaaaatgcagggaagggacagcactaaagatgttccctaggcatgtggccaagggaatgcactgaagatgttccctaagcatgcagccaaagaactgccaccatgtatacactgaagacattccctaggaatgtgggtgagggactgctaccatgtgcacactgaagatgttccctaagaatgcaaccaagggaccactgctgtgtgcagtgaagacactccctaagtatgtggctaagggacctccgccatgtgcacactgaagacattccctaagaatgcagctggcactgaagacgttcccctaggcataatgaccaagggaccccactgtatacaactgaagacgttccctaagcatgtggctaagggactgccaccaagaacacaatgaagacgttccctaagcatgcggctaagggaatgccgacatgtacacactgaagaggttccctaagaatgcgaccaagggaccgccaccatgtacacactgaagacagtccctaagcatgtggcacaagggaccgccgccctgtgcacactgaagatgttccctaaccatggggccaacagactgccaccgtgtacacactgaagacattccctaagcatgtggctaagggaccgccgccaggtacacaatgaagatgttccctaggcatgtggccaagggatcacactcactgaagacgttccctaagcatacagccaagggactgccaccgtgtacacactgaacacgttccctaagaatgtggttaagggaccgccgccatgtacacactgaagatgttccctaagaatgtggccaagggaatgcactgaagaccttccctaatacaaaagctaagacattgtgggtgtaccacacacttcctacagctgtgggaaaatgaggctcttcagggcacctccatgactagccacaaacccagctaggagagccacggaaagaatggggtggtgtaactgcagtaattaccaagacataattcgatctaatcgccttctaaataaatggctcccttaactctgcccagcccacttgattcacaccaaggaagacgtctttaacatacaaaatcaggctgtgaggagtaaaacttggacaatgccatttcatcacagcacagagccacggtgagaccagcacctcttatggaaagaaaacagacagctggccgccatggctcaggcctgtcatcccagcactttcggagtccaaggcaggtggatcacttgaggccaggagtttgagaccggccaggccaacatggtgaaaccctgtctctactaaaaacacacacacaaaaaaaaattagccaggcatggtggcagatgcctgtaatcccagctactccagaggctaacgcaggaga

SEQ ID NO: 1411 - DNA, 2500 bp, artificial
  synthetic oligo
aagcactggggttataggcatgagccactgcacccagcctgggtgatagagttatttttttcttatatttcatcacatatccatgcctgggttaccttccatagtgttattttaccacaacgacaacaaaattcctttaaaaatttttttctagaaatccataaatacatatgtcaacaaagttaagctgttgagttaagcctagttaggtgaaggtttgccttagaggtagtgtgtttagacttgacttgggaaaaatagacacatattggaggaatcctctggaatttaagggcacggaagaatgttggtgatatggtttgactgtccccacccaaatctcatctgaattgtagctcccgtatttcccacgtggtgtgggagggaccaggtgggagataactgaatcatgagggcggtttccccgatactgctcttgtggtagtgaatgagtctcaagagaactgatggttttataaggggaaacccccttcacttggctctcattttctcttgcctccaccatgtaagatgtgcctttcgccttccaccatgactgtgaggcctccccgtcacgtggaactgcgagtccattaaacctcttttcatgatcaattatcgggtctcctcaggtatgtctttatcagcagagtgtgaacacagttggtttcctggtaatttgcagtgatagccaaagggtctgtgcagtgcatagacacatatttctagggcaagagggcaggggctgtgcacacacagatgggtgtagcaggaagaaggtggtgcaggcaagctgaacagtgaaagaggatttagtgcagggactctttactgaagtctagccagaatgttagggaaagcattcagagatggtgcagaacctgcaggctgggaaacaggagcgctcacccccaactcgagaatgatggcaaaggaaagagagagaggctagaacccagcgagggagaactcaatgaacaacgccacctgacaggtgctaggacactggattagaggagaaagccaatgtcagatggaacccagggctaaatccctccaactttactctcctcctgtctccaacctcagtggcaattccccagggtcagaaccaaaaatggcagccagaaggcaagagaaccctatggatgtagtatctgtgagtcatcctcagcctccttgcctccccattccccctgccactctcccctgggttgagaaggttggagaagtgtacaaagtgggtcagagaaacaaaaggaagaaagttggcacaagcattcaagaaaagtgatagcaggtataggagaaagggatgtgccatgcttttgtaccattgaaacattttaataggggaacaaaaaactctaattagtatgtgacaaaggaaaaacagaagggactgaggaaggcggggagggagagcgtttattcatttagcagagatgtctgactgccaggcggacgcaggacctgaaaaacacccagggactgtagtgaatcaaactcagccctgtttgtttcgaatgcactcaacgttagccccgactccggcgagatttcatcgttttgggaaagattcgttggcatcctctctaaaagcatttgcccaaatatgtttttagaaagcaagcacgtttttttccccttggatcactacatgaaaaaatacttggaaatagtgctaatatgtgaatgtaattaatgtcactgcatggtacacttaaacatgattaacacggggccccggatgttttatatatatattatcataattaatacatattacattttagcatcctttacctccctccacgtattagtccattttcatgctgctgataaagacatacctgagacagggtaatttattttttattttatttatttacttatttttttgagacagaatctccttctgttgcccaggctaaagtgcggtggtgcgatcttggctcactgcaacctccatctcctttgatcaagcgattctcctacctcagcctccctattagctgggattacaggcgtgcagcaccacgcctggctaatttttttattttttagtagagatggggtttcaccatgttggccaggctggtctcaaacccccaacctcaggtgatctgcctgcctcggcctcccaaagtgctgtgattacaggcgtgagccaccatgcctggccaagactgggtaatttataaagaaaaagaggtttaatggactcagagattcacgttgctggggaggtctcaccgtcatggcggaaggcgaaagggatgtcttacatggcagcaggcaagaaagaaaatgaaagtcaagtgaaaggggaaacctcttataaaaccatcagatttcatgagacttatttactacatgagaacagtgtgggggaaaccgccccatgattcaattatctcccactgggtacctcccacaataaatgggtattatgggagctataattcaagatgagatttagctggggacacagccaaac

SEQ ID NO: 1412 - DNA, 1100 bp, artificial
  synthetic oligo
atacgctaaaatgataacccttgggacctatgagtgtgactttctttgaaaccagagttcttctacatattattaattacatgaaaacgagatcatactggattaaggtgggccctgatccaatcacctgtctgtgctgctatcacgaaaatatcatagacttggtggcttgtaaacaacagacattgattgactgggtgtcttataaacaacagacgtttattgactgggtggcttataaacaacagatacttgttgaccgggtggcttataaacaatagacatttattgctcaccttctggacgctggaagtgccagatcaaggtatgacagattgagtgactcgaggggactgtctctgtttccaagatggcgccctgttgctgtgtcctcacgtagccttagagcccagcctgttccctccagctcttttacagagcgctaatcccatccattaaggcagatccctcatgagttcatcacttcctaaaggtcccacctcttaataaggttgcatcggggattaaatctcaacaggacttttggagggaggctgttgtcatttcacctttcagcacagaccaaacatcgccccttaaaaaaccaggaagcttccccagagagaatataaattatgtcactagattttatctgtgtgtcctgcgtctctctgtttcacgttctgtgggacttcttatccttcagtgaattatttgaactggatctctagggcatgtttctgaagggcttgacttgttttaaaaattgaacaaatacattattcatcttagcttatttcctgttctgagtttttttttctttaatgggagacagaagaaagccaatttatataacagatctgattgccaaatcagtagtctttacatgttcttgcctttcagctaaaactgcaagttaaaactagagtttttttgtcttttgtttttgtgcatttaaatccttctattttaaaataatatgcttaaaaaaataaagaaaaatagccacccatgcaactctctctcatttgatattttcattcacagccagtgttggtcccacccgtcagatatctagactgtcatttggtgatgagatt

SEQ ID NO: 1413 - DNA, 2050 bp, artificial
  synthetic oligo
aaacaagaacaaaaaacaaacaaacaaaaatcctcaatattctgtttgcttttgtgaaatctttatttaatatgctagatttttttaaatgttgatgctttggaaaagcgttgttatctttgcctatgagcaagtttttcccggagtatttggcttttctgtgaagtaaccccatgtccttttgaaagactgtttctggaaatgcagctgccaagttgggaggaaacccaagcaaccatttgggaatgaccccacggaagagaaacaaggcctctggccaacacccccagctcttccgaggtacctgccagcaacaactctcagccatgtgaatgaagtcacttcggactctgcacctgcctcagtgctccagccaccaccaccacattcagcagaaccacctggccaacccatcagataatgagaactcatatattaagtccttaaaaaaaaaaaaaaaaaagcaccagctgatgccgtctttgcctgctgacaccttcaccacaccctttgctctgaaaaattcagttgacaaaattagtttgaaatgcgaatgccagggctttatttattgtcattattttggacaatatccccagtacgtttgggacattttatcaccgttcaaaggacctcttagtgtggagaaaactgagcctatttcggatttcaaataagtaggagagagatttaaaattactctgacctagtaaactctcaaaaaaaagtaatgcatttccctagaatgagatgatatttgaaaagctgattataaatcatttcattctactcactaaatcagggctgcgttgctctgctatctattaggactttaataatgtgttaccttttgaatgcagtaagaattcaatctttgaaactctcataatacaaagcttaggataatataaactcagtcaaagtgagattctttgacatgaactcttcatgttttttcattcaaagaggagaactctgtcctttccttcattctcccttttttagtagaaaaagtaattcttgtagaagatacgtattccttcagatctctcaaatttcctctctagtgacatctgcttcaccaacattccttttttccccttttccttgttcttgttcattttcctttatcgtctgtgtttttctcatacttaatttgcttcgtgatttaggaacttttgttttactgggatttgtcacttgaaagtcccaatcctttcacggtctatccaggcctttcaaccgtgccaataaccggctaagtctgcagtagtctggatggaattccagacggcgtccagtctttgtctctgcaagcctgcttctcattgactcttagatcggctctcctgttccagctgcaattttccacagtgcctctttgtttcagaattggagcagtaaccccttttctttttatttccagtcagctttttttcctgcccccaagtagcagagactgcagtgcacataaagttagggactcagcttgtgtctgcataaatatttgacctgaatctagacaagatgcaggtgcgtggtttttctgatttatttttacactcaggcaactcatcttttttgctgcttctaccctcgtgagaggtaagagctgggagtcacaccagattcaattcagccagtgtgctgctatccgtttcttttaggctgactctctctactgtttgacacagctgcctcgctagctcatggccatgtgtaaaatcagcattaagggggctgggtgtggtggctcacgcctataattcccgcagtttgggagaccgaggcaagcagatcacctgaggtcaggagttggagaccagcctggccaacatggcaaaaccccatcactacaaaaatacaaaaaattagctgggcatggtggtgcacgcctgcggacccagctactcgggaggctgatgcaggagaattgcttggacccgggaggcacaggttgcagttagccaaggtcacgcctttgcactccagcctgggcgacagactgagactctgtctcaaaaaacaaaaaacaaaaccaaaatcaaca

SEQ ID NO: 1414 - DNA, 1500 bp, artificial
  synthetic oligo
ctgcactccagcctcggtaacagagcaagacttcatctcacaaaaataaataaataaataaataaataaataaataaataaataaataagtaacctccaagccataattttagtgatggttttactttgtttgacatgtacgttttaaaagaaatttataataagaaaaaattattgaacataattatgttactcatgatgtgtccatcctcactcccccaaaaaattggcatcaaaatctcactttgactccagatgtttaccaaaatgcattcactttcagctgaaagatgttttgtggccaaaaagaaaaaaataacctggaaatagaccaatgtttcctcatgctgcaaaaggtctgctttggcttgataaggcgatcaggtgtttgcaaaacatttccaccctcttttttttttagtaacagaaaagttggcacttctgctagcccaacatttttgcacacagaagttttctcagttaaaagctgcctgggacggtgcctccagcttgaaattcttctgcatctctgcacagcactgtgctgaattttgcaagtgccgccaacaagaagctgcggcagggtgctgggaatttcacagaaagctattccctttttcctacctggttatagaaactgctttttctttagaatgttatagttaccctttgaatagtggcttatcatttcaatacatttttgtatgaattttaaatgcctatattcaacccaactttttcctttctcctagggggctgataccgtcaggacagcggcttgctgaaagttttaacaatgaattctgcaaaaaaaaaaaaaaaaaaaaagaaaccctggtcagagcctatgccaatttctctggtgtaaattttcctcttgtggttgatttaaaggtactcaggtgagattatggaatgcggatttggaaagagataatgccctgttggttctcataagctcatacgagctactcctagcacccctgtatgtcaaggtgtacaaggcagagaaagatgacaagctggtgatcttgggagggaaaaccttagtccccacaggtgattggttcaaagggcgctatgaccactgcagcaggagcacaatctgatatggagttcaatgctcctgggaagatgtgtttagaccggggatctccaacccctagctgcagatttgtaccagtctgtggcctgttaggaactgggatgcccagcaggaggtgagcagaaggcacctctatttacatctgtatttacagcatctgtatttgcagctgcttctgatcactgccattaccatctgagctctgcctcccgtcaggtcagtggtggcattagattatcgtggaagcatgaatcctattgtgaactgcccatatgagagatcgaagttgcatgctccttataagaatctagtgcctgatgatctgtcactgtctcccatcaaccccagatgggaccatgtagttgcaggaaaacaagtcacggctcccactgatt

SEQ ID NO: 1415 - DNA, 3450 bp, artificial
  synthetic oligo
ttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaagttctttcatggggagtttgtatcatggtcattttctagtatttagcattttcagcttttgtttcctgtcaactcaacattaaaagttttttaaaacgtccgggtgatattgttgctttgtttgctttcctggtttcattatccattttcaattttgctgctgtgaatttgcaccgtctccttggggagtgatttggctgtatattagtcagcgttctctagagggacataactaatggaatatatatatacacacaaaggggagtttattaaatattaactcacacgatcacaaggtcccacaataggccatctgcaggctgaggagcaaggagagccagtcccagtcccaaaactgaagaacttggagtccagtgtttgagggcaggaagcatccagcacgggacagagatgtaggctgggagggtaggccagtctctctttttgcatttttttgcctgctttatattctagccttgatggcagctgattagattatgcccacccagattaagggcggggggcctgcctttcccagcccactgactcacatggtaatctccttcggcaacaccctcacagacacacccaggatcaatactttgtgtcaatcaatccaatcaggttaacagtcagtatgaaccatcacaggcagtgtctacaagcaatgaaacatgcacacacctttctacctaattcctgcccattcctgaccaacgctcctaagaaaggaatagatttgatttttttcttgattttatatcttaaaaacctgttgtatccatgtctgtatgtgtgccagggtgaatcacaaagtcaggaagttagtgtgacgcagaataaggatatctttattcttttattttttattactttttattttgtttttgagacagagtcttactctgtcccccaggctggagtgcggtggcctgatctaagctcactacaacctccacctctccggttcaagtgattctcctgcctcagcctcccaagtagctgggattacaggcacatgccaccacacccggctaatttttgtatttgtagtagaaatgtggtttcaccatgttggccaggctggtctcaaactcctgacctcaggtgatccatccgcctcggcctcctaaagtgctgggatcgcaggtgtgagccatcatgcgtggcctagaatattcttatttccaattttacagcaacagaatgtcttctgtcttgtttctactttaaaaaaacagtttgctaaagctttctttgtagtgcagttgtgaattttcaggagcatcccatgaacattgaaaaggagatgcattcacgctttttaaggttatcgaggatgtgaaaattaaagtcggctttgtaaattctgccatgtctgtgagctcccagcatttgatcagctgaggcttcgagcggtgaagtagagtgcttttcccctaacgtgctctgatctggagcctgcgtgtattaccgctgggcacacggcctgccctgaccatactttagtgaagcagaggtgataaaactgggtttcccaggactcctgcaacacacagctttgatgtcggcaaactagaacccgggagccaaatctgcccacggtgtgtttttgtacagctttcgaggtaagaatttttttgtattattgtcgttatcgttgttttgagatggcgtcttactccgtcgcccaggctggagtccagtggcatgatctcggctcactgcaacctccgcccctgggttcaagcgattctcctgcctcagccacctgagcagctgggactacaggcatgcaccactacgcccggctactttttgtattttcagtagagacagggtttcaccatgttggccaggttggtctcgaactcctggcctcaagtgatctgcctgcctctggctctcaaagtcctgggattacagacatgagccacggtgcccagccaagaatggtttttacatgtctgaataattttcaaaactccaaagaacaataatattttgtgatgcatgaaaattatgtgacactcaagtttttatgttcataaagtccacttggcgcacagacattggttacatattgcagcagaatccatatggtttgcaaagataaatgcctttactatctgaccttctgcagaaaagcttgtctactcttgcctcaagaagcatgtaaaatacttacaacactggcacgttaggcatgctggaaatcgtagcaattattttgcaccttcactacatctgagaggatttcctgaacttaaccatttaacctaactcctcactaccttttgggaaacattttttttattaaggtgaaattcacaaatcatagaattaaccttttttttttttttgacccggagtctctgtcacccaggctggcgtgatctcatctcactgcaacctctgcttaccgggttcaggcaattctcgtgcctcagcctgccaagtagttgggattacaggcagtcaccaccacatctggctaatttttgtatttttagtagagatgggttgcatcatgttggccaggctggtcttgaactcctgaccttaggtgatccacccgcctcagcctcccaaagtgctgggatgacaggagaattcaccattttaaagtgaacaattcaggttgcttgctgctttcacagtgttttgtggccaccacttctacctagttccaagatattttcactgcccccaaaagaaatcccattagcagctgttttttatattggcttcctggggctgtcataaaaacatgcttcaaactaggtagggggcttaaaaaacagacagttaagctgtcacagttctggagcatagaggtctgaaatcaaggagcaaacagggtggattcctccctccgtccctccttccctccctccctccctccctccctccctccctccctccctcccttcctgccttccctccttccttcctttctctttcttcctttccttacctttcccctttccctccctccctccctcccttccttccttccttccctccttccttccttccttccttcctttcctcctcctccttcttctttctttctttcttcctttctttcttctttctctttcttctctctctctcgctctctctctctttctgagtctcactctgtttctgttgcccagtctgtagtgcggtggca

SEQ ID NO: 1416 - DNA, 3950 bp, artificial
  synthetic oligo
attagccgggtgtggtgtcgggtgcctgtaatcctagctactcgggtggctgaggcaggagaatcacttgaacctgagaggcggaggttgtagtgagttgagatcacaccactgcactccagcctgggcaacagagtgagactctgtctcaaaaaaaaaaaaggaagatatttcatagaagacaactcccaaacaccaggtcaacaacatgaacagacttaacactccagatgctcaaatttgcagagagaaaagtccaaggtttatttctccttttgggtctgtttgccatgaatcctgcttctctgggaatttagaagctgccctcataactaagactgattttcccctttctcctgcagttaatctatttaccagaggacttcaaagctgtttgcaaatggtaactttttaagtgcttgcctactgcttcatggtaggtagagtgtaagggttaacccacgagttgtatatggataaattagacacactcacagatctgcagggaagaatataattaaaaccattgtgaaagcaggagtcatcatcgaactcagctatccagtcatgtttcttctccaaggagatttcaaacagaagatgtaaattttggtagttacataaaatgtctcagatttaaatgaaagacacaaaaagccacatatctccttttcctgaacaaccgtctctgctgaaatattagttctgccacctacaaagacaactgaaggctgaggataaaaaatgcctcttggaagtcactgagtttgttaggtataaaagccaagacttcaactgaggtctttgcactgatgtgtacattaaccccacactgggtatcactgtacaatcatgtcctgcaggaggaagattacaggcggccagtgtcttctctggtttctgggttggtgactttgaacttgctacagctcccacacccgcagcgagcagagttgccaagcaagtgtgccggcttccagaagcctgagatgcccattggtgcttgggaaccaccccagtttccccatcgtctgtgctgctgcagattggttggggcagcccggggaggctggctccgacacacgactgagtgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatacttt

SEQ ID NO: 1417 - DNA, 1450 bp, artificial
  synthetic oligo
cgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctc

SEQ ID NO: 1418 - DNA, 1500 bp, artificial
  synthetic oligo
attacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaaccc

SEQ ID NO: 1419 - DNA, 3550 bp, artificial
  synthetic oligo
gtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgaca

SEQ ID NO: 1420 - DNA, 2700 bp, artificial
  synthetic oligo
ttgggaggccaagatgggtggattgcttgagcccaggagttgcctgggcaacatactgagaccttgtttcaacttaataaagaaaaattggagaccaggcgtggtggctcatgcctgtcatcccagcactttgggaggccgaggagggtggatcacttgaggccaggggttcaagaacagcttgcccaacatggtgaaaccccatctctactaaaaatacaagaaattagccaggtgtagtggtgggcacctgtaatcccagctactcaggaggctgaggcaggagaatcacttgaacccgggagactgcagttgcactccagcctgagcgacaaagactagtctcaaaaaaataattacaaaaaaataagaaaaaaaagagactagaaaagtcttgaacacatgtgtgtgcaagcatgtgtgcgtgcgtgtgtgtatgcatgcacatacgtgtgtgtgatgatgataaaagttgcacttcatatagtgcagggaagaaagaatgaaatatagcccatacatggtgctgaaactataggtaacgactccccatcgttttaagacgattggcaggtgatctcagaaggcatgtcgctggaatgagagggacacatattgacaaaaactaaatttaaaaagctcgtggagaaaaacggaagtgcggagacatggagatggactctggaatgcagctccatccctagcctgttctagggcatggtgctttcctgcacagagggactctttccctaagggtgttaggaaggggctcccctactcactgtcccgttgatgccacctggctgcgtgcagaaacctctcacaataatgcatcaggaactcgtggtctgagtgttgggctgtccccaggagcaagggcagaaggtcttggccgtcaatcactctgcaggaaggaacatggcatggctcagggttggaacagggactctggacatttgtccctccagcatccaccagtcccagccccaggtggtgcactctccttatgttgtatcagtggagggaaagtctgggtgtgaacgcagatggatggaaggcatgtgtgtgcattagcacgcttagaagaagaatgcagcagctgcccacgttagtcaccaccaaacgtcacctttggctaaaaagtaattaattggccaggcacagtggctcgtgcgtgtaatcccagcactttgggaggtcgaggcgggtggatcacctgaggtcaggaattcgggatcagcctggccaacatggtgaaaccccgtctcaactaaaaacacaaaaattagccaggtgtgctggtgtgtgcctgtaatcccagctactcgggaggctgaggcaggaggatcgcttgaacccaggaggcggaggttgcagtgagcctagatcgcaccactgcactccagcctgggcaactgagtgagactcagtctcaaaaaaaaaaaaagaagaaaaaaaagctgaaagagccagcacccaaaggctggaatgtaacaaaagcccactaagagttctacccaggcctttcctggaccttgaagcgcgataaaataatgaagggattcttaacaggacccatttaggattaaacaagttttattggggatctgaaggaactccccagacctccacaaacaagttttattggggggtctaaaagaactccccaaacctccatgatttagcaggagacaagataagggtaatcaccccagcacctggaaccatctagattaagtcaacttactgaggctccagaggaaggtcctcaggactcagaccttagttctagatgaaaggaagttgaatcacttatgtctttagatggatgcacgcttacatgtggacatacagcttagaaggtatagaagctctggaaaactttgtaattttgagttggtctagtgatcatttccagccttctccccgtatctggttacagaaataaaactcctttctttcctcgttcatttgcatctcgttattgggccatgagaataagcagcccgaccctcggtttggtcggggaacaatttcagggacgccttactgcaaagccaaagtgacatgttcatttgccataagtgttgctgtgtctgtgcaaagctgaattgtttctttgggttgttctgtacctgtcctggggcacctcgccgcccgccagccggaccacggtggggaacacgtccatcagactcgtgggctcgccaatcactcggccggccgggagcaccccgggccagcggaagatcccgggcacgcggatcccaccttcccatcctcccatgcccttcccacctgggtttgaacagaaacaaaagaaagtggttaaaaaccagaaatagatgctcagcctggctgatttaacttttctgcttgtttcacttgtttgaagtttctctctccctgagtctctcaatttctctctctctctctctctgttttagtgacattaaaacattcaatctcatgtagttcccctgtagaggtttgattttatattttttattaaccttgttattggttagtgtgcattggattaagttaggtccttcactacaaatgactcttgttcttagaagacacagacacagaggagaaggccatgtggagacggaggcaaagactggagtgatgtggccacaagcccagggactcctggaacccccaggcgctgggagcagcaggaaggatcctccc

SEQ ID NO: 1421 - DNA, 1600 bp, artificial
  synthetic oligo
aagccctaagatgtcaaagcatcagaatataaaagctgcctgggcacggtggctcatgcctgtaatcccagcactctgggaggtcaaggagcggggatcttttgagcccagcatttcaagaccagcatgggcaagatagagagaacaccccccagtctctatttaaataaaaaataaaaaaaccaaaatgtaagaactagaaactgtgacgaatacaccaggctgcaccctagtgcagttgtaaagagagactgacctgatcgcacagggtatctgcccgtgaggaaggcggctctgcttggggtgcacaaagatgcggcagagatgtgttgggtcagcttcacgccgtcctctgcaaggcggtcaatattcggagtcctatggagggacaaattaacagctttacttgttaaaattagacaggcttttcataagcatagctacatgctacttcatagaaggtctgctggtcatcgctgagtgcttcaagatgttctcaggaatgacccaaaggtaatgtcaaagatttctaatgtcttctgaactttcgaggaaacatcaactcatttaaataggaatgagtggctggacgcggtggctcatgcctgtaatcccagcactttggaaagccacagcgggaggatcgtttagggccaggagttcaagaccagccgggccaacatggcgagaccctgtctctacaaaaaaatctacaaaaatagaaaaattagccaggattggtggtgcatgtctgtagaaccagctacttgggagactgaggaaggaggattgcttgagctcaggagtttgaagctgcagtgagctgtgattgcaacactgcacttcaacctgggtgacagagagacaacctgtctctaaaataaataaatgaatgagtagatagagtgactaagtttccacaaggcactgttggtactgagagaccgacctcagagggaatgcagaactgagagcccagggcaccttctctggagctcacagtgttcatgggaaggtttgacttcatggacgccaacacactgtaagtactacatgagggtggaaggctggaattcggacaggaggacggactagctctagctcttgacagatggacacgccatattttggcattaggagggtgtggacttgtctgtctgaagcagagcttttcagcaggggaggattgaaatcccgcataagtgctgggcttggctagatggatagggttgggagtgagacagagatcaatattggtcttctgcttacaggcaacgacactgatttctcctgtatgtttgtttatttgtttgtattttgagactgagtctcactctgtcacccaggctggagtgcagtggcactatttgagtctcactacaacctccccctcccgggttcaagtgattctcctgcctcagcctcccaagtagctgggattacaggtgcccgccaccatgcccagctaatttttgtatttttagtagagacgggggtttcaccatgttggccaggctggtctcgaactcctgacctccaagtgatcagcctgccttggcctcccaaagtgctgggattacaggcgtgagccaccacggcc

SEQ ID NO: 1422 - DNA, 3100 bp, artificial
  synthetic oligo
aatgtcgctggaagctgatggtgccaaacttagcagtacagcgagcatcgctggcagccagctcctgaaacacaaactgtcagagactgcgtcatgctcctgtccatctcatttgcagaacttgtgtatgggggaagttggcatcactattttaagaggtattgatattatcatcacatttcagaatagctttgaggacatctcttaggcatttgattgtttttctctggttacaattaactgataccgttgatggctttatttggccttgaagttttttgggttttttttgatgctgtaaagtctgttgttaagtgattaaactcatgattaacagaaagccttggtggggtgcagtggctctctcctgtaatctcagtattttgtgaggctgcagcgggtggattgctttaccacaggagttcaagaccagcctgcgcaacatggtgaaaactcatctctacaagaaatacacagcttagctgggcgtggtggcacgtgcctgtagtcccaactcctgggaaggctgaggtgggaggatcgcttgagcctgggaggttgaggctgcagcgagctgagatcgcaccactgcagggcaacagagcaaggctgtctcaaaactacaacagcaacaagaaaaagcaaaaacagccagaaagcctgccttagtcatggtttcttggatggatcgggtccccagaacagctattgccccttctccattccctcttcttcattgttcttccttaagcaaactgtgttgaacatagggaatggaggctggggttagggtttggaccacccagcagagcaaggaagagacacaagcttggggcaaggtgagaacacagtgagctgctacttctgagtctatgaaaaccctctgttcattgtagcacacagatgaaaatacccaggactgacttctttagcccactggtatctgatgagaagtgggtttggaggtgaaggaggttccagcctggaggagaaagccctggtagttgcgtaccatgagggaacatttccgcaggggttggtgacatacagcctgccactatcattgctgcctctttcatcgatgccaccctgggaatgcacatggacagcagggccatagtgtcccaatccccagtgggatgcagtaaagatgtaatctgagtctccaaggtttgtagtaggggaaaccctgattttccctggaaaaccagacacctggccgatggtagcggttgatgcccacctgatttgcagagaatgaaatacaattccttctgaggctgcctggggcaacatcaaatcaagggagcctggagcacatctattaatcacgggtctcatgcttcattctccagatgcaggataaatcactatcagtgcattctgagaaagcaccatcaagagatccagaagcggtcaggcgtggtggctcatgcccattatctgagcacgttgggaggccaaggtgggagcattgcctgagcccaggtgtttaagaccagcttgagcaacatggtgagaccctgtctctatataagaaaggaaaaaaaataaagaagggaaggaaggaagaaagagagagagaaagaaagaaagaaagaaagaaagagaaagaaagaaagaaaagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggaggctgaggcaggagaatggtgtgaacccgggaggcggagcttgcagtgagccgagatcgcgccactgcactccagcctgggcgacagagtgagactccgtctcaaaaaaaaaaaaaaaaaaaaaaaaaagaagagaaagaagggaaggaaggaagagaaagaaagaaagaaagaaaggagactactaatgagtgcatataattgtatcttaccaagaatggtgcagatgtaacatgttgtctctctctctacttcctgtaagacataaagatgtccacaatcacattgacagcagaaattgacctgattataaataaaacagtaagtaagtaattaggggaactttgattcccgttcatgatatcaatagcaaaaatatcttaaaacaatgatcaaaatctataaaggaatgctcttcccgagtgaaaaggcttcaaaaatgtttaatactatgttaagaatgtaaaacgtgtttcaatacacagccagatggtcttcagagaaagaggaagaaagtggtcatagggtctccatcccctttatcagctttcatagcccatgagtgatcacaaagtgatgagagaatcccagtgtccggaagcagattattttgtcttctgcttcccgagcccagggcaggggtgattcctaatgtccagaaatgcagagagagagtcctgatttggaagggggaagcggggaaagatcaaagcttggatgatacacaaaagaatctgagtagagggtatgaagatcagaaatacaatgagaggctgcgcgtggtggctcatgcctggaatcccagcactttgggaggcggaagtgggaggatttgcttgagcccaggaggtccagacttgaaaacagaactgggagtgtcagtgtgaaggaaaaaggcctagaggactctgcaggcactgagtgctgcatgaaggagagacgcattcgccttcattgctaggggtaggtgctgccgggagagggggcgaccattgcccacacttggaaatgttctgtccacagagggaaacgggcgacccccaaagcacagaggggcggcccctcagtctcgccgagaagtgagggagagcccagggtgtagagcaggaaaggaatgagatggaagataacaattagagttgcaggcagcaagaggtcaccttcagggtactgcagtggtctgaccccatgtggcttgtgcatgggactgaggacgaagctctgatttttctttttatcttgcccaaattcctatctaaggggtctggagagtcatgccctacaaaccaaaaat

SEQ ID NO: 1423 - DNA, 1150 bp, artificial
  synthetic oligo
acaatgtctcccgggggggcagaatcactccggttgaaaacactggtgttaaggacgtactttgcaggtgactggagaacacttaattacgatcatgctgggtgagccatttcaatttgtttctcatactcccacgtccttcagagctggtagcagaatcaagctccacacctgaaactcttagcacgaacgttatacaacagtacttgtcagctgcatttccaatactagcatcccaaaagagatactctcttagcatcaagtaaagtcatttactctttttttgttttttgttttttttttgagacaggggttcgctctgttacccagactgcagtgcagtggcacaatcactgtcactgcagcctcgacctcctgactcaaatgatcctcccacctcagccccctgaatagctgggaccacaagcacacgccaccacaggtggatcgctttttttttttttgtaaaaatggggtcttgctatgttgccccctctaatcgctaactcctggcctcaagcaatcctcctgcttcagcctcccagaatgctgggattacaggtatgagccactgtgcccatcctaacaatacatattctttagcaaagttcagatccccaccgtcatcctaaccttgtcttctgcacggagctttcgtctctgaacaaggcggacgttcgctttcccttgactccaagttgaactacgaactaaagtggtctcattgtcatcttgggcaccatatgctagaagaagcaagacaaatacaagacaacaacaacaacaagaacaacaacaatgtagcctgtgaggttagaagcaacatggaatcagtcatgttcgatttctctcattatttataattctgtaaaggtggtttcatccatctttcccaaacaaccacttcatattccactctagctggaatttatttatcctgggctatggtttaaagtgtcactgtaaagggtgacataaggagccactccttttgggcagaattccttctctacctcaaattccttctctacctggccaccattttccatattccttgcacaggtaatacttgaaaatattcagacataacttaacattttcatatgggttgcatacaagaagacaatctggaaatccatgtttctaaact

SEQ ID NO: 1424 - DNA, 1500 bp, artificial
  synthetic oligo
caagataagtcacagtttgtaaatacaagttttcccatctttaaaataaagacagccacttttctgaaaaactcattggcaagataaagaaagctgcactgtaaagtatattgtaattcctggccgggcacgcagtggctcacacctgtaatcccagcactttgaaaggccaaggctggcagatcacttgaggtcaggagttctagaccagcctggccaacatggtgaaaccccatctctactgaaaatacaaaaattagccaggcatggttatgcgggcctgtagtcccagctgctcgggagggtgaggcaggagaatcacttggatccaggatgcagaggttgcagtcagccaagatgagaccactgcactccagcctgagtgacacagcgagattctgtttcaaaaaaaaaaaaaaaaaaaagaatattgtaatttcaattcccaattattttgatggatataaaagggaacgttattctgattagtcagttctacaggaaatacatagaaaattgggatggggatttaacacaactaaagcaacttatttcaaaggcatagtgttcactataaagaaatgctaaggataataaatgagcaggtgggaagagttactgtatgcattccagaataataaatagctgtgctagttgaattgcatttgcccacccccgcctctatgtacgtgacagagttgtccttcctctcagcgatggtgtttcattttggaatacagtacttttcttcttcttctgagtgcaaacttctgaaaacggtgctctgccgaaccattgaaacgaacaatctcccagttatcagccgcctctgttgacttatatggagtgcctttgaaagaaacagagctattttaatttaaatgcatttaaggggtgttaatcaatcacattttattataaataactttcttttctctgaaaaccaccatctaagtgagctataaaatactagttaaaattactgaagaactagtggtgtcggataggacaaagaggggaatcttgtcatgggataaatttctcttgtatatttccactatgtgtgtttacctctaattataggtaccattgtaacatttactgtctatatttaatcccaaagaggagatagaatacagagaggggccaggcgtggtggctcatgtctgtagccccagcacttttggaggttcaggcgggaggatcacttgatcccatgagtttgagaccagcctgggcaacataccaaggctccatctctacaaaaaaatacaaacattagccaggcatggtgtcacacgcacgccttgtagttccagctacctaggaggctgaggtgggtggatcacttgaacctgggaggtgggggtagcagtgagccgagattgcaccactgtactccaagaccccgtctcaaaaaaaaaaaaaaaaaaaaaaaaaaaaaaagaggccgagtgcggtggctcacgcctgtaatcccagcactttgggaggccgagg

SEQ ID NO: 1425 - DNA, 1850 bp, artificial
  synthetic oligo
aaaaacaaacaaaatgttgaaaataaatggatgcatttgatatgattctgttccactatccaatctaagtaatggtcaattattttatagattgttcttcagtttttttttttttttttgagacagagtcttcctttatccctcaggccggagtgcagtggtgcgatcttggctcactgcaacctctgcctcccaggttcaagcaattctcatgcctcagcctccacaattgctgggagtagaggcacctgccaccacgcccggctagtttttgtatttttagtagagacggggtttcaccttgttggccaggctggtctcgaactcctgatgtcaggtgatccgcccgcctcagcctcccaaagtgctggaattacaggcttgagccactgtgcccagccttcagtttggttttgtccagtgttttctcatgattagactgaggttatgcatttttggcaaaaaaatcatcagaattgatgtaagttttcagtgtgtcatgttacggagtgcatgatgtctgtatgtcctgtcctggtgatgttaaatttcatcacctggattaagtggtgtctgttggaattctccactgtgaaattattattttttctgatccaggaaaggttaagcaagagtctggcaccattttaagtctaataagaaacatttactacctgatttctctgaagcctgctacctgcgggctacatgtgcataataaaaactttggtctcctcaacgccttatcctcacccagacatttcctttctactaattacaggtctttaatcagaaaatcctggaatccacctacgacctggaagttcctcactttgaatggaatcccacctttctggactaagccaatgtacatctcacatgtgtcgattgatgtctcctgtccccgtaaattgtataaagccaagctgtcacccaaccaccttgggcacttgttctcaggacctccttggggctgtgtcgtgagccattggttaaatgaataactcttttcaaatattttacagagtttgactcttttcatggacattaattggtgccctacacgtggggcctcagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagc

SEQ ID NO: 1426 - DNA, 1200 bp, artificial
  synthetic oligo
tcactattggattcctgagttagtgaaagaaaagagcttgtatcttctaaaagtggaggtgaattatgtttattctataaaatacataataaatatcaataataatagatacataagagtcataattctctatgggaagttatttctatagcggagtaagaaaaatctactgaacctccctctctgccaccacaaataaacttccacgtccccagggaaaaccttgttaagtggtatacactgccctcttgtgcagactgtttaaacagaaaagatctcacgcacctattacataaaacattttttaaagctctgcataaaggaggaagacaactaaatctgccaaggtttcttgttgatttattatagctgtttcataatccacaaagccatagtcagcaatacccgcaaacattctgtatacaaacgactagctaggtttacagttcaaatgagtataaactaaattgtttctgtttccaagaattaagcaaccatggattttttttaaatgttccaattcgcaatgttcaaatctatgtggtacacttatcttttaagcgttttgcaagatgcaccagcaccacgtataatatgattcgccagccacaaaagaaccagtcatgcctgagatttctagaaaattttacaatggttaaaaatgtctccactggggcgtttgtgttggttttcctgaaaggcatgggatggtcgtgcagccgattctcataacgtcgggattgctttctctctctctctctctctctctctctcgtctccgtctgcaaaacaatggagcagggttttcctggcttcttctgcttagcgccacttttcttttctttttaattcccaggtccacaaacaatttttagagctaaaagaaaaggtatgtggcaatacttaattgctggacccatgaagccaggaggatctgagactcactccgagagccagggactttccaatgcgttgggaagcagcctctgcaggaagctcggcatgggaaaaagctgtaccggctgcaaatcgtcccttctggttccggcgagtgacagcagagggtgacacagatgctcacattgtcagtggtccttgctgtgttcatctgaccctgcggtgctccacacaggcaactatgtccccagggacactcgacaatgtctggagatagctttgggtgtcgcaaccggggtggtt

SEQ ID NO: 1427 - DNA, 1150 bp, artificial
  synthetic oligo
aattgcgatcatattataattcaatatgtttttgtaaaacagcaatgcagaaacaagcatcttttaaactctcttatctcattgatttcattgttttactttgaataaaattaaccaagtttctatgaaaatgaacctttccaaaacaggggccagaaatgcatatttacttcttcaagtgctgcattttaaattggtggccagccaagagtgaaagaaaaagagacggggtttctccatgttggtcaggctgatctcgaactcctgacctcaaatgatcctcctgctttggcctcccaaagtgctgggattacaggcacgagccaccgtgactggcctagtgaagggtgtcttaatctgtgcaccttgggtaactcggggctgaacgactctctgtggtcgagtgtcctgtgcactgtagggtgttgagcagcgtccctgggctccacccaccaaatgccaatagcacccattcccagctgtgacaaccaaaatatctccagacatgttacctgggggacaaacttgacccacgttaaaagctcctgatgtaaaaaaaaaaaagcaataatgtattgtgccacaacttggatgaaactggaagccatattctaagtgaagtcactaaggaatagaaaaccaaataccacacattctcacttacaaaagtgggagctggtagggcacggtggctcatgcctgtaatgccagcactttgggaggccgaggcaggaggatcacttgaaaccaggagttcaagaacagcctgggcagtgtagtaagaccctgtctctacaggaaatagaaaatattagctgggagtggtggtgcgcacctgtagtcccagctactcagaaggctgagtgggggcgacttgcttgaacctaggaggttgaaggtgcagtgagccatgatcatgccactgcaatccatcctgggtgacagagtgagactctgcttcaaaaaagaagtgggagctaagttgtgggtatgcaaaggcgtacacagtagtgtaatggacattggagactccgaagtgggagggtgtgagtgcagcgagggatgaaggactacctattaggtaccatgtacaacacctgggtgatgggcgcactaatgtcctagacttcactcatccaagtaaccaaaa

SEQ ID NO: 1428 - DNA, 1650 bp, artificial
  synthetic oligo
gcggccacggatggtggttcatgtctgtaatcccagccctttgggaggctgaggcaggaggattacttgaggccagcctgggcaacagagcaagaccccagatctacaaaaaaaatttaaaaattaactgagtgtggtggtacatgcctgtggtcccagctactcaggaggctgaagtgggaggattgcttgagcccaggagatcgggtctgcagtgagctatgatagcaccactgcactccagcctgggacacagagcaagaaaccctatctcaaaaataaataaatatactcaatggtcttgaagtgttaaaaaaaaatactgaagaaattttaaaattaattaaagcaacctgcagaaaaatctatactagattattaacctcaattatttaaaaatgcaaatcaaaatgtaagactttttacctatgcaattggcaaagaaaattcaaaagtataataacacttatgatagcaaatgtctgaggaaaagtgtgttaagagaacaacaacttaagccgcattaaatttaaaagagttgaattgagcaaagaacaatttgcgaattgggctgactcccaagccagagtcggctctgagattccagtgcagccacgtggtgggagatttgtggacagaaaaagggaagtgacatacggcaagtagaagtgaggttcagaaacagctagtttggtgacagctcagcgtttgccctatttgggcgcaatttgaacagttggctacatttgattggctgaaactcagtgatgggcataagagtaggctatggtccttctacatctccacttgttagagttcacaatgtaccgagaaagctttgggctgaacttaaaatatgtaaggaggcagctttaggctaaacttgatttcacaagtattttttggttgttttctatttaaactattgattgagtatacacaagaggagtattatattttctggaggccagtttgccaatgttaaaatgtaaaatgactgtaagtaacaagtttaagggtgagaggtgtggcaggaggtattcatctatcttcttttcatgtgccaatgtgtccatttaaaatactggagggggaacaagaaagaatgatggagaagccacatttctgccacattcctgatgtaggtgggtggtgtttactggcttggctaattcctcctgaccctcctagcaggcaggacagtctaaggaaaagactagaagaccttaaataaagccccttagctcccaagcccaccataaaaaggggagaaagaggaacggccttgcaaatggttcttggttcctctggggaccctaagtcaattaatgatgcctcctggcttgttccagctcttttgaggtgactattaaaatattcaagactagaggccgggcgcggtggctcacatctataatccaagcactttgagaggctgaagcgggtggatcatctgaagttgggagttcgagaccagcctggccaactggtgaaaccctacctctactaaaaatacaaaaaaaaaaaaaaaaaaaaaattagcagggcatggtggcaggtgtctgtaatcctagctacttgggaggctgaggcaggagattcgcttgaacctgggaggcggaggttgcagtgggccgagatcgtgctgct

SEQ ID NO: 1429 - DNA, 2150 bp, artificial
  synthetic oligo
ccagctttctattttttgattgtgttaaaatacacatagcagttgcatagtgtcctcatctgttcatttcctcctccgccaagccctggcagcattgttcgattttctgctttgatgattttgactattccaagtattttcatgaaagagaagtacttttatctgaggaatttgagcactttcaaattattaggcccagaaatgtattaagacgagacagcaatcgtgtcctagtccccgctttgagctatgtatacatctattgaaactgcttgccattgtcacacataactataagttaacctaataataccacactggataccacaacccacaccctatggcttaacgagagacagccaatcacgaatcagtattatttctgtaaacagcaagaatttctgacaaacaattttgtatccactccccgtgaaatcgcttctctataaaaagtgtaaaaattagctgggcgtggtagcgtgcacctgtagtcccagctacttggggggctgaggcaggaggatcacatgagcctaggaggtcaaggctggagtgagccgtgttcatgccactgcactccagccggggcgacaaagtgagaccctgtctcaaacacatccacttgcaacggctgctaatcagagcgtctaagtgtatattcagggcaacttgaatctattcttccagtttgcaagcctcaagcttggctcaaataaactctctatttatattaattttgcctcagcttcttccttttaagttgacggcctcaaataagcagaaccacactctagttgtccttttgtgcctggcttatttcacttagcgtaacagcctcaagattcatctgcattatagcctgtgttagaatttccctccctttgaaggctgtatgattcaatcaataacaatttgaaacaaaagctttcaggcagggcttaatcttccaagaagaagacaattttaaatacatgggcaatttgaaagacactctaaaactagcaaggaagcactttatggtaaccgcaattgccaattaacttgatgttgaaatcacatagacaaagaaaaaggtgagtgaagagagggctagaatggctttgttcctcttaattgtcttattgtacactggaaaagttgcttggtttgcaaagacaggtgtttggaggaatctacagcgcttagaattacccccgggtgagctagctgtttcacgggaggatcttttgactcagcttggccatttttcaaatgtggaaaataatcagctctcagaaaggcagtttagagcagtgagtgctatggtttggctgttcgggaaaccagggtcctcttctgtctgcctcctgggtttctgatgtttccttggagtatcttcctgcttccccaggatctaaggaacagaaacatcagtcacagctctcatttcactgcaaatgtttttctctgcatgcgtctctactggaatacttaaaacccggcagacaggttttttttagagggttatgttgttgaatacagaaagaattgaatgcatctagctcggagacctctcaaaaaaaaaaaaaaaaaaaaaaagaaagaaaaagaagagaaaagactgggtgtggggctttagggaggcaaccggctccgcagagctacctggggagttttcagaacaaagcagatgcaatgtcgatggaatccaatctccccgtccttgcccttgcaggtccccagggggaggaggctttgggaaaaggcagacctcacgactcctctttcaaattgtccctttgaagacctgccttagatctgtctacagaagcctcaccccaagcagaaggagagcctggattttaaaatttttgttgtttgctttttgcagacaggtgggtcctacctgaggctaccaacaatgagatccttcaggtgataggatatgggccaggtctcccaccctcagcaaggcaggtcactgcaaggcttgggaggtgccctaaggggatttaaacaaacttgggatcttgtgcctcctactgttacaggacaggggtcccgagactgtatagggtaacttcctgacgttgccatggcatctgtaaactgtcatggtgctggtgggagtgtagcagtgaggacgaccagaggtccctcttgtggccatc

SEQ ID NO: 1430 - DNA, 1850 bp, artificial
  synthetic oligo
aggagctcagaggatagatgagatgcacccactgctgggaactgggagaaacgcaatcccaaagacaggagcagtagacgggatcccatttccttcagggtttgacctggataccacaaagcgctccaaaaaatgtcacggcgaataaagggtgtccatagtaaactgctgatgaagccacaaggaaaccactgcccatcctgggccttcttcctggctccaggtcccagcaggatgtcagccaccagccatggagggatgggtgtagtatctctgagactgtgtggttttagttttctgtttcaattgttgcaagatgcatgtaacctacaatttaccattttagccactttgtgcaatttgatggcatttagtgcattcgcaacagtgaattcgtgtttggtgcacaacagtgttgtgccatgatcatgccaatcaacgatcaaacacttttttttttttttttttttttgagacagggtctcactctgtcacccaggctggagtgcagtggcaccatctcggctcactgcaacctccgcctcccaggttcaagtgattcttgtgcctcagcctcccaagtagctgggattacaggtgcccgccaccacattcggctaatttttgtatttttagtagagatggggtttcaccatgttgaccaggctggttttgaactcctggcctcaagtgatccgcccacctcagcctcccaaagtgctgggattaaaggcgtgagtcaccatgcctaatcaaacacttttattacttacaaagaaatttcacccaatagttatcagcccctcaccctgcaatcctctccccacctgaagcttccagcaaataccactctgctatctgtctctctgcctattctgggcctttcatataaatagaatcatacaatatgagacctttgtgtctgtctttttaaacttagcatcatgtttccaagttcattcatgttgcagcatgtgtgagagctccagtcttttttattgttcaatcatagtctgtcgtatgtgtgagctacatttatgtaactgcattcgtgctccagtgaatgtttaagttgtttctactttttggctcttgtgcacgaagctgctcttcatttatttatttgttcatttgttttgagacagggtcttgctctgtcacccaggctggagtgtagtggcatgatctcggctcactgcaatcgctgcctccctggctcaagcaattctttcatctcagcctcccgagtagctgtgactacaggcgtgcaccagcctcggctaatttttgtatattttgtacagactgggtttcaccatgttgaccaggctagtctcaaattcctaggctcaagtgatccgctcaccttggcctcccaaattgctgggattacaggcgtgagtcacactgcccgacccatggtgctgctatgaatatggtgtgtacatatctgttggagtctcaattattttttaaattcttttcatttttagcgatgggggtctcggtgtgttgatcggcaggctggtctcgagctcctggtctgaagtgaccctcccatcttggcctcccaaagtgttaggattacaggcgtgagccattatgcccagccccccgccccctttttttttttttttttttttttgagatggaatctcactctgtcgcccaggctggagtgcagtggcacggtctcacctcactataacctttgcctcccagattcaagcgattctcatgcctcagcctcctgagtaactgggattacaggtttagatttagtagagacaggatttcaccatgttggccaggctggtcttgaacactcttgacctcaggtgatctgcacg

SEQ ID NO: 1431 - DNA, 1000 bp, artificial
  synthetic oligo
tgaggaacagaaaatgggcattttttaaaaccacatctggaagaggggaggagccacagagttcatttccaacaccttcctgtatgttcttttccggtagttgtgcatagtgtatcatacataagttagctgctttgcaaacagtgtgtagttcaatcttcccttacctttggaaacaacctggtctcaaaaagcttatctgtgttgtctctgaaataacctttgggtgcagtctgtacagttaaaccatgtgaattcagtaacttgcagctaatgcttttgctatccttataaaatgaggagacagacgcttgatcctgacctagctcttgatatggtttggctctgtgttctcacccaaatctcctgttgaattgtaattccgaatggtgggaggtgattggatcatgggggcggatttcctccttgatgttcttgtagtgagtgagttctcacaagatctggttgtttaaaaatgtgtgacacttccccctttgtgcactctcgctctctcctgctgggcatgtgaagattgtgcctgcttccccttcgccttccaccatgattgtaagttttctgaggcctccccacccatgcctcctgtacagcctgtgaagctgtgagccaattaaacctcttttctccataaattactcagtttcacgtatgtcttcatagcagtgtgagaatggacgtatacagctctattgagtccaagagtcccaacttcaggcattcctgtctggggacaaacactcaccatattagtctgctaggtcccacagtcctcagaaatttattttctcacagttctgcaggccggaagtccaagaacaggatgctgttaagattggggtctagtgaggactcttttcctggctggcagatggccaccttctcactgtatcctcacatggcctttcctttgtcctaaagcagaaaggcggtggtggagatggaaagagagagaaagagagagaatgagggaactgtggttgtc

SEQ ID NO: 1432 - DNA, 2700 bp, artificial
  synthetic oligo
tttaaaaaatagctgcatgtggtggcacatgcctgtagtctcagctactcaggaggctgaggagttcaggaccagcctgggcaacattgtgagacccccatctctacaaaatattaaaaattagctgagcgtggtggcacgcacctgtagccccagctattagagaggctgaggcaggtgaattgcttgagctcaggagtttgaggctgcagtgagctgcgattgcaccactgcaccccaacctggatgacagagccagaacctgtctctgtgtctgtctctcccttttttttttcttacaccaacttcggtacattctcaaaccttttaatcgttcacccttgaagtactggtttgtcatgttctgaagctccctgtaatgggatgggtttctgatcacccttgggctgtattgggctggcatcatttaaatatccgggcatttagattggttcctgatagggaaacttcatgtttatttcacatgtaggctaattgtttggtctgcctgcgagtcctgaggaattattaaggaaaaccacacctgtttctgctttctcatcctgaggaattattaaggaaaaccacacctgtttctgttttctcatcctgaggaattattaaggaaaaccacacctgtttctgctttctcatcctgaggcattattaaggaaaaccacacctgtttctgctttctcactcgcagtgagagagttcctgggagagatgcagtacccggagggttcattatcagccccagccgctgatgcgctatcagcctgcggaggagggagccctggggcttcactaaccacgggctggagctgccacgcaccagctccagtgagatcggggttttcgttttcatccaacactttcaacccagtttctgatgaaagggcttcttccagtcaccagagaaagtgagtttgtatgtttttcctccagagcattgctgcgtggttcacaaatagggctgcttatgacaaaatattaactttggcagttttggagaaaaaggacaaataatgcattcctgggagaggtgtgcagcacatgggctgcgatgggtcacagggacaggtgcctggaaaccaggggtcaaagatgagcctctgaaacggctctctttctagtctgcatgcccttcactgctcttcctttataaagataacaagtctctatatgtcgttttagaaattgtggcaaacactgtgtgtcgttttagaaattgtggcaaacgctgtgtgtcgttttagaaattgtggcaaatgctgtgtgtcgttttagaaattgtggcaaacactgtgtatcgttttagaaattgtggctcacgcctgtaatctcaacactttgggaggctaaggtgggaagattgagcccaggagttcaagacctgcctggcccacatagaaagacaccatctcaaaaaaaaattgtgtggcaaagtatacataagacaaaactgaccattttagctattttcaagtgtacagttgagtggcattaagtgcactcatattgtgcatctgtcaccaccatccacctctggaaattcatcttcccacctgaaactctgtcccctagtaaccaccattctactttctgactccatgaatttgcctactctagaggtactgatatacgtgaaatcatacaatatatgtcctttagagtgtatttctttttttaaaaaaatgtcaacttttattatagattcagggggcacatgtgtgggtttgttacatggatataatgcgtgatgctgaggtctggtgtatgaacgattctgaagcaggttgttcatctagggtgatacctgaggtttgttgtctccggctgaggaaatcaaggatgtggacatacaagaagtgaggttaagggcggaggtttaataggtgaaggaacaagaagagctctctcctgcagagaggaggttccgagtgggttttctggtctgcagcaaaatgcaatgggttttatagatgagcttgatgaggtggtgtctgatttacatagggtgcaagagattggttggaccaggtgtgtcatttgcatagggcacaaaaaaactggttagggctaggcatgccatttgcatagggcaccaaaacctggccaccttcaccctaatcttttattatgcagatggattctctacctggttggcactatgttgcctgttcctttaaggtacacggtgacaaaagggaagatggagcctccatgttgaacgtgcctggctccaaggtagcccttttctattggcacagctgccggtattcacctgtgcaagcttccagcttgcttatctatgtctgcagcatgatttttcaggctgctctttgttagaaatgattttggagctgctttttgttaaaagagaaattccgccgaggactcttttaccctcactatctgcctgagtaatttctttctagctcctgtatgaatcccatcattcaggtagtgagcatagtacccaggaggcactttcccagccctgtcgccttcccctcctctcccgtctagtagtccccagtgtctgtggttcccatctttatgtccatgagtacccaatgtttacttcccactttataagtgagaatatgccccatatttggttcctgaattaatttgcttagaataatggcctccagctgcatctttgttgctacgaaggacatgattttattcttt

SEQ ID NO: 1433 - DNA, 1750 bp, artificial
  synthetic oligo
ataaaagcacaggtcaatcaaggaaacctccgtgtaggctaacagcgctattgaggctttactctcctaactcatgtggacagttagggtttaagaaaacaatattgttgggggaatatgatctgtcctagaatgctagccatggctatttgatgtcaacccgcattccaactcctactgctccaaaaacgaagtcagtgttccatcagtccacatgagtctttgcccatcgcccccagcacccgtgtcagaagctgttttcaaaagtgattttcatgtgtcccatgtcagggttgtcacctaccaccacagaatatgtttcactctactaacataccgtgggaattgacgcctgtgttttttaagttgattagggtttttttctttctttctttctttccttccttctttcttcgaagaagaaggaggacgacaaaagaaagaaaaaagaagagaaaaggaacagtgagaagggagggaagcaggaatggagaaaggagagaatcagcaagattatttcttcacacgtctgtcgcccactccctcatggggctcccaccgcctgtccagtgagctgtgtgccacactgcgtggaagagaggggcatcgagacaactgcatgtaaactttcttaaaggaaagaaacgcaggcgcagaggaagagaagcttttttgccttttccaaagaaccagacaataaatccagatcggcacatcaaaatcaaagatgactgcagcttcaaagcttcccgggaagatcaaaggcgaagcgtgaagaaggcaggcaggatctctgaggataggaggaggccttctcggcccttgtggagctctgtttcaacaaaccagaatctcccgtaagtcagctcccacgtttaaaatcagctccgagccttgcacagggagctttagggaaagcttcttcacggaaacaaaaatgaggcgttttagcaataacacagaaatcaaactctcctggcagaaagcttccaggcaaactccttgccctaactccctaaaaagattgtcttgccatacctcgcttttttgctgcaacctccccaagtgctggaaaacagaacaagtattagccccacgtagcttaaattcttagaatttgattactgatttctgtataattggtcggaaattgcctctacctctctctgctgctgttataaaatatttcttcctttaactcatgtttgccagaacacttgtgctgtgtaatcacagagatagtcctgtaatatccgagtgtggcagtgaattggattccacataattagttgaacataattgagcaataatgtgtagttatggaggaaatttactggacctcacacaaaggaaaatttctagagcagtggcgtgttgttcccgaagtaattgtgcaaagcatcacctacagtactgactctgtcttttctgctccggaaacatcattaacacgcctacctctacagcaacattctctacgctgtccttctctttctgcagagtggccgatttcagagtggtcgtaagggaacaaatcagtaactctcaagatcacaggatgtctttggcacctaacatataggtgtccaataaaaagctattttcaaaattatttattaaaaaactcactgaaactgttctttcatagagaaaacacaagacacacatatttctaatatcattatctccttatctagatttttcccgtatgtaaaatagctgttttccactgctttagggactgtacaac

SEQ ID NO: 1434 - DNA, 1800 bp, artificial
  synthetic oligo
tttttgagacagagttttgctcttgttgcccagctggagtgcagtggtgcgatctcggctcactgcaacctctgcctccctggttcaagtgattctcctgcctcagcctcctgagtagctgggattacaggcgcccaccaccatgccaggctaattttttgtatttttagtagagatggggtttggccatgttggccaggctggtcttgaactcctgatgtcaggtgatccacccgcctcggcctcctaaagtagaaaattacattttataccttctagaccaaacaccatgaaactaatataattaatttttttctcctggtagacttgaacaatgaattgggctaaaattatctcgccaacaaaatgcacacaataaaatgagaagagggggaaaattgcacctgattctttctagcacatatcctatcagccgcagctaattaactaaaggcccaattacctactgcgcaaaaactgtaaaggagcagagaagcctattctatgcagaaaatcttcatcataatgaaatcattagcttcaagaggaaaaagagttgtacttcaaacttgggaagcgagaagtgtctgatggcttgtcgaattacaagtttctattctacttgtggaaaaaaatattctgttaatgtgttttatgtgtcagatgaaaattgtatcacctagcacagcctgtcttacattctggaaattaatgttttagagcagggggattttttttcaacccagaacataatgtatgctttgacaaatgagctctcacttttgtcaataatattcaaagagtaagtagcaataggacagaggcagttctatccatgagagaacagccaggcatgctttattgcagagaaagaaagggaaaacagaataatattctgtacaagaaaattaagtttcaaaagattcaaatgtaatgtgtcaagaaactcttatttgcaagtggaatttaaaaggaaaccaaacgaaatgatggatgcatgtttcagcctcataagaggacattctcttctcctctttccttataaacagtatggatctgggcccactgctacaaccatcagacttccatcacagccagcatttgtgtttgaaagttctgtttcatcttccccacaccctgaccctccaaaaagttcagtaggaaatcatcctgggatcaggagagcatcaacagtcgctgttcctggtggttccagccactccccaccccctgtgcaaacaggctccagagctttgagttcttcattccccggggccctctctctccaccaaaacctcacagctttacatcccgtcccataaggaccaaatcccagctccgatataattagctccagccacagaatagtatgccgtaagttacacaaagatcatagctgtatacaaaccacatggaaatgtcttccgtacattttaaagatcttttccacatagcacagccttcttgcagatagtataatttacttatttgttattatcacatattgtctctccctctgctagcatgcagatccatggtcctgggggagctctgtatgctttatttgatgatctacctatcccacgccttcaagcagtgcctgggaatccctggcaacaggtgctccatgaatacgtgttcgatcaacatgctgagtgtgcttaaggctttccatttttactgtacagactttttagtagttttgtttataaccaacatatatttgtgcattcatagggaattctgactgttaagattttaaaaaggaaataagagaaataaaaagcctgctaatgacag

SEQ ID NO: 1435 - DNA, 2750 bp, artificial
  synthetic oligo
agtaggaagaaggaagatggaaggaagaaaaaagaagaaggaagtaggaaggagggaggaggaagaaggaagtaaggaggaaaaaggaagaatgaaggaggaagaaggcagtagaaaggaggaaggagggagagggaagtaggaaagaaaatggaggaagaggaagtaggaagaatgcaggaggaatcagggaaaaggaagaaggaagtaggaagaagaaaaaaggaagacaggaggaagtagaaaggaggaagaagttaggaggaagaagggggaaaaaggaagaagaagacgaaggaggaggacacactttttacacaaagttctgctaatttaacccttatgtgaaacagttaaatagcaactcctagtgagacagcaggcggaaagatttgaaggaaaactgttgctgccacaagggaagtttgatggcaggacttggagtgtgtatgcatgatgtactaattgaagcattagtacagtttctttgggggggtgtcagatgagtgtagaggaaccccctactctccacctttgcctagggcaatgtctgcatcagagattggtgccaacgtaataatcagcctcacagaaagttggattcagagtctggaaagatggaagatacaatctttacagcctatggatagaccctcctttccaaacttcagcgtttggaatcttagtacaatttctataccaaaggtgcttgccaaatgaaactctggatttacaacaaattgtgttttgaaaaatactgtatttgccaggcgcgcagcggctcatgcctgtaatcccagcactttgggaagccaaggcgggtggattacgaggtcaggagttcaaaaccagcctgaccaatatggtgaaaccccttctctactaaaaatacaaaaattaccgtggtggcaggcgcctgtaatcccagctacttgggaggctgaggcaggagaatcgcttgaacccacagggcagaggtcacagtgagccaagatcgtgacactgcactccagcctgggcgacagagtgaggctccgtcagagagagagagagacagagagaaagaaatatttaaattgctccagttcaaataagccggtaataagccaaaccacctgtctcatagagagctggagagagagaagggtcagcaagggaaatgataaaataaacaaatcactgctatgaaaatttatatggctcaccccgcctctgaaatgagagttcaaaatagaaatgcttgctccttaacacgggttatcataacgagatgcatttaatacatgagtttgctggataccatggttcagccgtgctgtattttttttccatgatagatttgaaacatccatcgcttcatttgctgcctctttccacaaagcagatactggagagcaaatctcatgcagatgatgttttgtctagaggcagcgagctgttttataataaggcagatgtagaggatgcaatttcaaacacacacccgaaagcacagggctcactacctgtaactgagaaaacgaggcagagatggatgccttgtttgcattcatgcaggacacatgcagaaagttctgtctgccagctacgggaggaatagacaaagcacctcccaccaccaggcacaggtggagtggcggaggacggggcggtggcagtagtcccacctctatgcacagagttccatcttcacaagtaggaactcaagcagttgaagaccagcagcaagctggccatgcagccgcagtgtaaaaatggacggcctctccgcacactatagacagtcccgccttgagcaaaaaactaacatacacgatcctttccaacctgcagaacctgccattccaaggggcccaaaataaccaaccaacaaaaataaacagcaaaaacaagccaacaaaaactttagtgccttagaacatcttcatttgcctttatttttcctctgcttttcatttaacagtgctctctttttttcagaaaaataattagtgacaaaagcttggtatactttagaattgtagttaaaaggaaaaggacaccccaaatggattgtggccttcctcaattctgacttttcttaaaatgaactcattgcaatttagggaagaaaaatgtagatttttccatctttcactacagagcatgatgctgtgctgatgacggtggcgttatatatatgtatttgtaaatctagaagagtttgacgcattcctaaagaataccaagaatataatttttaaaacatagaattaagggcgtggcaaaatggctcacacctgtaaccccaacactttgggaggatgaggtaggaagatcacttgagcctgggtgctcaagaccagcctaggcaacacagcgacatcccgtctctacaaaaataaaactagccatgcgtggtggcatgtctataggtatatagtcccagctattcaggaggctgagacaggaggatcacttgagcccaggaatgcaaggctacagtgagctatgatcatgccactgcactccagcctgatggagcaagaccccccgcctcccccccccaaaaatagtagaattaaggaatcttcctgcctggtcaattttttccagatgtctcctgctttttcctctccttgcctggctataaactttaaagcaaagaaaaactaattctagaagaaaaatccaggagaaatttcaaacaaaataacatgtagaaatattatattcaagagctaatgcggagctgtacacaaatagataat

SEQ ID NO: 1436 - DNA, 1900 bp, artificial
  synthetic oligo
caggagtttgtgaccagcctgggcaacatggtgagaccctgtctctactaaaaatacaaaaattagctcggcgtggtggtgcacacctgtagtcccagccactcaagaggctgaggcaggagaatcacttgaacctggcaggcggaggctgcagtgagctgagattgcaccactgcactccagcctgggtgacggagtgagactctgtttcaaacaaaataaataaaaaaataaataaataaaataaaaataaaatccttcaaagtaacttccaaggttctgtcctctgcagagacctttctaagccacctggttatgattctcctctcctttttctgttttctgctttcctttcccccaaggaagcatttcaattcctctgcccatgttatgtcagcctcctaccatctgccgtcctgaccacaacatcgtagcctccctcctgccatgtctccataaccccatacaacccagcatatagcaagacctcgagcaagcactactggctgatggaatgagtcaagagatgggggttgttgggcagagcccagtagagttatccagctcactgaaaatcccaggctttccaaggaaaaggtttgggatttattttccttagttcatagtctgtgctttgaggattcagcagaacaaatcagcagattagtaagtgggcacctgacatccagatgggaagaaaccacactgctcacaatgactatggactcgaaactgcattttcaggataactgtgttctggactgtatactctcatgaaaacacaagctcgcttagcaacaaccagagtagttggaggaagaatgtgaaaagatggcagaattcatctacaattcctccgatacacaagagtaattagccagttttcaaaatttgtaagtatcacccctctgaaatgctggatgaggaaggcaatgatcccaagctttttctgtttctctctgcctgcactggcttgtctattcttccctatttggtaaaagccaagatgtctcaaattgcagctctcttcctgaaccatccagcctggagtatccccttccctgggccaaactattttcgagtgcctaagggctactcccctaattcactgtctgcaatccttagttatctttttcctataattctgtttaaatggcttaacttgattaagagttccttgaagacagggactacatgatgtgtctttgcatctttcgtttatctaaaatgtctccaacttcagctgaaactgaaagtagaaacccaaagctttcaacagtgttgaaacatcttctcccgcccctatatgcttcaagaactgctgagtaaattaaagtgcacatctgagaaggcagctccatttctccatgtccagcagagctagctagtcaaggtcgatagcaggaaagaaaaaacattgtgataaacactattaaatgtccaggctgaaatctgccgctaaagcaaagcaaagctttccaattacaaacttactttgaactcctattttcatttccgacatgtaattattactaaataaaccaggccgagtgaattaatacttttttggaatatagtcaagaaaaactataagtacaatattttcagtaaattatttacaagaatgggaaagggaggtgtcaagcattttgctctagtataatgtattggaaaattagttacagtgtctattagattcaaatatgaagaagattacatgtatacatatagatatggatatatgcatatatacatgtgtatctacacacacgtgtgtatgtgcttgttcatttcggatcaagtttaccatttgggtataattacttgagtttgggcagtggtctctcgtctcaccttcagctgtaagtactgaacatggagccctgtgaggaattccatt

SEQ ID NO: 1437 - DNA, 7750 bp, artificial
  synthetic oligo
caaatccactgtttggacttctcagggtacagtctatttgacgtccaatcttttcattgtctctgcttaaaccgaacaacaggtgagcaactcttcctggacctcccttgctcttgctgttcctactgcatcaattcatacagcatggaaacctccataaatacagcatctactgacctgggatgccccttttgtttttgatgtctgaaccagggagattttgctaaacttcaaaagtcttaagcagaagaagaaatatttaggtttgtgcatgacgtggaagctttcccatcatttctttaaagggcttccctataggctttaataggcttccctctattttctatgtcccatttataaacaccgccactcccggctatagcagttgggattcaaaactacttcctccgctggtgatttatcatttcactagtttatactcatcctgcatctgttccttagggcggccataacaaagtcaaagccaagatttactcaagtctgaattcaaagcccaaaataattccatcccatgagctcattttcccagcactttctctaccccaggataaaatgccatgaatctatttactatccccacagtccttatacagatccgctgatttcatctgatattttctgacctatgggtccttttctctgcctgaaacaaaatatctacttaatctttcttcttcggtcttcatcaagtacttcatcaagtactttaattcctaaattcaacgatgtgactcctttactctcctctgtagctaacagaattacacagaaaatcctgcaattaataatagccattaacacctttttacacctgtgtagagttctgtcatttattttatataaatatatatttcccactggttttaacccacagtgaacctgtcttgaaatacagcctcccgaagacccctccaggttggccacactacctgggctcacttctacgggcccaccttgctgtgctcaggccaacacaccttcctgagcctactggcaactcagcttcccacatcacactgattacataattatgcctctggcaacttttattgtcatttgtaagtggctactattgaaggaagccacacatttttcctgaattttaggtcatttttgctctcccagacacagcttccatttggactaccaagaagtaattgtttacctccacaagtttccatcatgccatacactaatggccgactagttatgtaatcattaaacaaaatcctcaaagcttcaaggtatttcaaaaaaatatttttattataaagcgatggataacccttagctaagttatgagccaattcctattttgtaaagttgtgaattctattacacaatggttacctttcatgggagaaaagacagagcactattcgcgtccaaatgcagaaactggaagcaatgcaaactaccaaattgtcttcagctaaaacaaaaaccaaacatttcataattgagccaagaccctaatccaactcataacagtaaatcagtggcacagatggtagccatggcgaccttattttggctctatataatctacatgtcagatgtcgcacacgtgagatgggatgttagagtattaccaaaatagtgaacaatgggctcacttcagattcccagattccttgaccttaaatttaaactacccttttaaatccatctgaaaatattcaagacagcactcaggcttcctgatttatgctaacaatttgatcgtccttcccttcttttagcaaagctcaccacatttgaatacactgaacgtttaaccacctcaacacatttctgatcaaagcaagtgtgaaataatttctcccgctttgtacagcaaaattctttctgcaagtaagtaagaggagataatgcaattcaaaaggcctgaagactgggcttatattatagaagatgtatttgctaatataatcacatgaaattgtttcttttgttttcttaagcctcagctgggagacagtggcaactgaaacagtgttctcacattgtatcctgatcttcaagatgctttacaaatgaaattactttctgataatgaaatccactagactgtgggagagcctattaggagaagccccatgatccccctcactgctttgggccatttcaaagctgatgctcaggggcccttccctgactctggaaggaaagccaacgagcagatcctgcgtggagagagggaacgcggaagccctgtctcccggccttgtgctttaacatccaattctcattatttgggcctccaggggcaaggagctcgcagtaccggggaggtgaaacaccacctgaaatgcaggaaaagtctggagtttgtcgtaaaattttaaaatccgcatccttcctatagaattgtctaagcttcaactttttcagaagaaatgttctgatcaggaataatcctagtctaactgcaagtctttaccaaagcgggcaggcaatctgaacactctcttgcctatgccctgctctcccatgagtcgttggagtttaacttgcattttccgccccgttcaattcccttggtcctgggttgagtggatcttgtgagagaaaaggacacgaccccagaatctgcagagagtgtagagttttccttggagcaatgggtcccatactttagcagcaagtatatcaggatcccttggaagtattttttttctttttctttttttcttttttagacagggtctcactctgacaaccaggctggagtgcggtggcacaatcttggctcactgcaacctcaatctcctgggcttgagcaatccacccgcctcagcttcccgagtagctgggactacaggagcacaccaccaagcccggctaatttttgtattttttgtagagacagggtctcactacgttgcctggtctggtctcgaacccctgggttcaagtgatccgcctgcttcagcctcccaaagtgctgcaattacaggcgtaagccaccatgcccagcctagaagtgtcgttggaaagggccacccacccaggagttcctgattcagcaggtctaggtcgggcccaagaatgtgcatttctaataagctccccagtgaggcagatgtggccacagagagcagcacttttccagaaccgctaacctggagtttaattaaataagctgtggggaggatgtgaaaaactcattgcaagctcattcgcagaagctgccacttgattggcacacattgttttgtcgcgacatgttttctttaacacctgtctgattgcacacattttctatttggagagaagccacacttcccaggttagaatcacagcttcccgcaagtgtgtggtctgaaggaagtctctgaatgtcctggggtcttagtaaggacgtcagaagggggcacagaatgaattggggcaagtagagcaaagcagtcagactgcccggtatgtgagacagcccagaaatgcagtgatttttattcttatttttacccgcctcggatgtgaaagctgtaatataaccgactctggtaaatcaacaccagtgggtcgtaattccttatagcattcatgtgcagcccctacaagtgttaagtggtttagcgtctccttggccctagatggtactaagcggaagtaagagtatgttgtgctgttacgtttaagaagatgacttgggccgatcacggtggctcgcatttgtaatcccagtactttaggaggctgaggcgggaggatagattgaggccaggagtttgagatcaacctgggcaagatagtgagagccccctctctacaaataaaaaattaaaaaattagctggtgtgatggcatgcagttgtggtcctagctacttgggagactgacatgggaggatcccttgagcccaggaggtcaaggctgcgttgagccatgatggcaccactgcactccagactgggtgacaaggtgagaccctgtctccaaaaaaacaaggcgacttagtaaaaaatcggggggaaatatggcaataaatataagaaaacttaaggaggaaatattatgtctataggaaaagcatggttatatatcaaggtaaatactgtgcccagttctcatctaattattgtgagggttgtcaaagaagaaaattgattttataacctctagaattttttcaaagaagggagggaggagggaaagaggagagagagaagaacctgaaaggaaacgggaaatgaaaagaaaaggaagcaaagggaaaagaaatctctcaaaacatcaggtgtgcctttgtttagttgagtatagactgtctgtggtggcttggggtcgtggcgttttaattgcacaatgcaccaatatgatgctgcgcgtgcagtgtaaacagctaactgaaagcagagtaccaaatgaatacacacaagcctcggaagccgcctcaaccggggcagctgctgcccttcaccgagccctggaacttcttttgttacctgagcccttaacactcgtctccaggcaaccggcgccccctccccaccgtctagagtgggaggcgccggcccccggcagggctgcggctctccggtttcatcccaccggtccagattgctgaggagttatgtttaaataacttctctattccgtaatcagtacgctcctcccgacccattaatacagcgaagctgcagtctcatatttggggcctcgaaatcacttctgattgcagggtgggaaaacaaaccaccaccaaagttacaggttatacacgatacccagacagaggcccacaaacagatgtgtatacctatatgtgcacacaaacatgcacacagtacacacgcacgcacatgcatgtgtgcatgcaaacacgcatgtgcgtatatacacagaaacacacaaatgcagacacaaacatgtaaacgccatgcatgcaattgcgtacacacgtgcatatgtaggcagtatcatgtctgtacacacatgcacacctatgtgtgcatatgggtatgtgtgcatacacgtatgcatacagacacacatgcccatatacacacatgcacatgcatatacacccacacatattaatatggtgagctctgtttttcaactgagagactgaataaagtagggacattttaaggcctttcctcaaagaggttcattgtttaaaattgtaggccagggcaacaacattctaaagactcgaggctttgaactcacacctccagtattccagtctctgctgtgtgctacatcgggcccttccttctcagagcacaggaactgtcaaccttggggttctgggtggaaccctatgggttctctctcttatcacaatgatggcttgccctggggccgacctagccacctccaactcctaccaagcaccacgaagctttccataacaggagaccaagtcaaagaaaggtaatggccaccgcctttctcgtattgatcttccgctaacaggcagatcataactgagcacgtcaacccaaacctaatgtattccggggcttactccttggcaaagtggaccagccctgttctccctgaaccaaggcaagaaaactatgtagaaagcagaacatgagaaatcaatctgataaaatgagaccagctcagagaacagtaaacagtgacctctctccctcagtcacctgtctgctctgcaaattaggaactaggtcttcctagcaggtaggcaggtgccaggtggggcccaggtgtgggcggcagtgggaaggggagaggagaacccaccctatacaccgcattcccgccggcagaccaaacagccggcggcactttggtcgctggatgcggggagcaaagaacaattcattaaaggctttcaggatgaaaatcctcacaacaaattgcctttctcctctccctctgagtcttcactcttatgtaaatgtattcaaaaaaccaccactgtgctttcagtgaaatgacaccacaaagctaccagaggtctccgggctgtctgggtgcttggcaaatgtttctaacatccctattaaaacacagcccggatctgcagcatccaaacggagggagattagccgcgaggcagggcgccttcggacggagctaagctggggcttccgaagcgtctctcctcctgatctctatcaggcaattttacgtaatcagaaaaaatcagcttgcaaatgaaacctaaacttcagagtcaaaagttgaaaatggaaagtttttttgtttgttaatggatatggttttaatccaaatgaacaacgtagttatatccatcaagtcctgattctgtgaagtttccagtcaattttaatgccagcttttgttccacatcttcaaaagccgataagatgaacaggagggatgttcattagagggtcaagttaaattgccatactgccatcagtagaaagaaaaaaaggaggtcagcatgtgcaagcactgcagtttccaaatcgtttctataccttttcatgtcagggatgacaggaaagattgtatttcacttaagccctgtcttcccccaaaacaatttcttatataaccatatatataaccataatcagttaaatacaacaatgaaatactttgtggtaattgtccaaggtagaaattcagagtaatattggagtattaacccatttttgttttattcatgtcaagttcatataccagtttacttgtgattggattcctcaagtatcacttcaatatcatcagactcagaagggacagtccctatttgccgtgccgggtatgctgtttgatctgtcccttataagcacatttatgcttgaagcctaatgccatttaactgtgtatcataatcacgacaaaaagagaacggaaaggaggaagcaccagtcaattatctcatcgaacccccgaaagaactatctaccccccacctcacaaaggagcaaacagattcatgatgatgagtgatctgccccaggcccccctacaccgggctggacacaggctccagacccagctgcatcatcactcacccgcttcacccacacagacgcacctgcagatccttcactgcctgcagatgaaaacacaccatttctcacctaatccatgcgcagctccattttggctcttgggcagggatctaatatcttcgcaagcataaaagaaagaaatctcaccctcacaagtattaatacacaacaggatgaaagagtctcgatactcaattccagcagcctccacggctgcccaaaaaacagcagcatattgcacccacacagggtctcagatgaattcagcaaggaaatgtctgcttccctgattttccctagagctgggattctcaatgctttaaagtcaattccatttttatatcgattagatttttaaatagtattataccttattttaaattctcacagggccaggcacagtggctcacacctgcaattccagtgctttgggaggccaaggtgggaggatcacttgagacctggagtgaaagatcaccctgggcaacatagtgatccctcatctctacaaaacattaaaaaataaaaattagccagatgttgtggtgcactcctgtagtcccagctacaggggagtctgagcagggaggattgtttgagcccaggagttcaagaccagcctgggcaacatggagaaatcccatctctacaaaaaattagctgggcatggtggcgtgagcctgtggtcccggctactcagggagctgagatggggggatcacctgagcccaggaggtggaggctgcagtgagctg

SEQ ID NO: 1438 - DNA, 1350 bp, artificial
  synthetic oligo
ttgaaatgatttattctttattccctctgtttttcagttttcttttttgttttctcttcctcgaactgctatgttcagctactggacctgctggagtggtcctgtaattttctcttttgtcatccattgcttcttggtgtttttgttctatttcctaggagatctccccaactccctctcaggaagtgagccctgtctgtatacacccagatccagctggcatgtacatccatgtctgtcagcctgtcttccaactgccgacaccgacaactcttggcttggggactttctgtggtaaccagattccactccactcttgagggcagcaagctgtaaaggggggcgggggggaattattctaacgtggagcagttctcagctaatgactgacgggcttcactcactcagcacggctccctggagatctgtcaagttactgcacacatcaatggtttgttcctttcattgctgagtagtgctccacagcacagacgtaccacagtttctttaccacccatctgtcaaggaacactaggagctgtttgtagtttgggaccattatgaataaagctgctatgaatattcgatgcaggtcttaggaactaacgaaatttatgtgaacctaatttctctgcaacaaatacccaagggggcaattgctcagtggtacagtatttgcatgttttacggtggcaggattttgaagaatcatcaatgccaagctacaggagtttggatttcaaagaatggcatgaaaagtgttcacaaacttttgggtagacggcatgtgatcagagtagtcccacattaaaagtaagaatcccgtgcaatatggagaccaaattggacaggaagagtctgggccacggtaatcaaaggtaggacaaggtacgtgaactcagacggggtcactgagggaggacaggggaaaaggacccaggagcaaggtactttgagatcttagggagttaattccacagttggaaaaaagatatccttgtaaatatgcctctctggacttcttcagccctcaggaagacgttcgaggagaaatataaacaaagaaaagcaaaatagaaactagttgtggtcaaatgtatttttaattaatgtgtccgtctaacattaaaaatgattcctataaacaaaaactatggcttcagtaatagctgagagaagattttccccctcattttttccagtctgcagcctccgaagcctccaagtactgcttttaataaaataaaacacaatgtgcttctgtgggtaaattatgattttcccctaatatattctaattcaaactattttcagagcctgatctgaaaattgctcccatatctataaaaa

SEQ ID NO: 1439 - DNA, 3950 bp, artificial
  synthetic oligo
aagtctaccctctaatcccacaagaaaacatcttgtaaaaataaggaaaaaaatttagtaagtgactatcctgctttcttgtgtatctggatttaatttttcattatttacatcaagggaaaagaaacatggcacaaagtggcttttttgcgtacctttaaaaaattttttctgttgagcatttcctacgaccagacaatggttctaagcattcagttatccaactaggattgctcatgtaatcctatgttgggattagtactgttatcctctttttcacaataaggaaactgaggctcagagacagtaggaaatttcagccagttcatccagctagtatgaggcaggataagagtttgaacctgggaagtctgatcccaaagcctacacccttaaccattattctatgcccctggtcatttgaattcataaaatcagcctccaagggcatctgtacttagtggctttaaaacaagctattttatcatctatcccacggtgcagaacagaatggaattcccaagaaatctgggagtcccctgtacaggtgttgcataccttctacaagtccctcacaccttccagaagcttctcaaagatgccggtgatgctgcttcgtattatcaatgtacaaagcaatgcactgaaaggggttttcctgacttataagactataattgaaaaaccaagtgcttctaattcaactacctcaagaaattccaaaaacagagtacgttttaaggaaatgtttatagtcaaggactagggttggtggtttggtgtcaagtcaagcagcatcaagaaagatttaattgttgttctagtcccatgttgtagcattatgtagtatgctgcatgtgtgtttatttttttaattaatttttttttttttgagacagggtctcaccctgttgcccaggttggagtgaagttccagctcactacagcctcaacctcccaagctcaaggaatctcccacctcagccttccaagtagctgagactgtatgcatgtaatggacaggcacatggcaccacacccagctaatttttgtattttctgtagagacggggtttcaccatattacccaggcttgtctctagctcctgagctcaagccatccgcccacctcagcctcccaatgtgctaggattataggcatgagccaccacgccgggcctgtatatgttcttggccagttttaagatgagaaacacaacagtggccaacacaaaatcaaaatatacttgtaaaacatagttaatctagggaaattgataactaatatgtaattaaggagaacatagcaattggtacattggaaagcaacttgactttgctaatggcaagctgtttgctagaaacacagacacagacacacacacacacacacacacacaaggttataaaagggtaaataataagtgtggttccttttgtaacagggactcagtaattcactaccaggaagttttctaaaaactcaccctacagagaaaagaatctgaatgaatgtaaagtgttaaggcagttgatggctgaggaattgtcaaattatcaaaatgccacgtgatgatggtatctgagtgagactgataccgctaaccataaaataggtgagccctgcaacagcttgacaaggttaagcaccttaggaaagcaatgataataaagatgaaatactaattaaaatatcttcttgagtttatgcactctccttggaaaaaataccaagaaatcatcactggatactatctaactataatacagcactatgatagattaccgacttgtgtttttttctttgaggtattcagttcaatgaagaataatttaatttagaatcattaaaaagtgttagagctgaaagaatctttaaagagcatgaatgcaattaccttgtttttaaacggtgaacctaaagcttggacaagccgactgaattaccccagatcctgtctttatttcatttgtgtttccgttccctcattcagcacacaagacataaaccagtaaccacgccaagccagggtgatgttgagcctgcacaacctgtgccaccgccaggcagtgcaaagctaatgttagatccagacctcctgatttctggccaaagatgcacagaaaaaagcacaaaggcatctatgtccattgtcggagtcaaaagtctagcaataaagacagttttttttttcgttgttgaaacggagtctcgctctgtcgcccaggctggagtacagtggcgcgatctctgcccactgcaagctctgcctcctgggttcacgccattctcctgcctcagcctcctgagtagctgggaccacaagcacccgccaccactcccagctaattgtttttttgtatttttagtagagacgggttttcaccctgttagccaggatggtctccatctcctgacctcgtgatccgcccacctcggcctcccaaagtgctgggattacaggcgtgagccacgctgcagccagccaggagacactattaataccgaatggtgatgtctatggcaaaagcaccaacaccatagccatctccgcagcagcctaaatgattctgacagccatgggccagtccactgattccagaaacacttaatagtgagttccggaaaagaaaaagcaatgccccattttctttggatgtacagcatgcggcaaagcagtccactgtggagaccagagtacgtgatcaccaaagatggcttgactgagcctagcaagttgcgttagagggcttctgctgccattgtatgtcgcttcttgggcacttttctcatcttttttgacactgatctttaggaagaaagaggggaaattaggctaattgtggggaaaaaggaaaggtaaaaatggccaatggtcagagagacttgcaactgcccgaaaacaggcaagtaagcactcgtgttaaaatagagccacgatggtagagttagggatatcagcagataaaagccaaaagctaacagtaaaggagaaacacacatgaatgccttcatcacagaagctgctgatctctgcacatcaggagcttacaaactgaaagagttagagcagcatagacacacagaaagtggatgccaaaggaaacaactggcacactcatcccagctgggattcagggcctcactactcatcactggcacccgcattaaagacacaaaggaagaaactagaagaaatgaagctacaagatagccttcaccacaatcactaacacatggaatatgcgtagtgttaatgtgtagtgttaaagcattagttgctcttcattagcacaaaacattccttcatttcttcatttgtcaccagctgttttttttttttttcatctcttttctgtgtatctgtgttggtttaactcttttcattggtaagcccctaatgagtagagatcaacaacatctattaattgaaactaatgccgaaaagtacaaaaaaatgtggatagaaaaaaataaacatcttagggatgaaaagagccattgaaatttcaaacatgatagacagaatctactttaagctggctgaacacagccaagaaaagaaatcatgattagaaggctgaatcaaaaaatcttcccaaaacagacagacaaagagttacaaattggtttaatcaaagaaatattgaggaactccaatccatatcaacctaaagttccaatagaagagaatgaaaatagtctgggcgcagtggctcactcctgtaatcccagcactttgggaggctgggacagatggatcacttgaggtcaagagttcaagaccatcctggccaacatggtgaaatcccatctctaaaaaaaaaaagaaaagaaaaaaaaattagctggaccttgtggtgtgtgcctctgatcccagctacgctggaggctgaggcaggagaatcgcttgaatgggggaggcagaggttgcaatgagccaagatcg

SEQ ID NO: 1440 - DNA, 11650 bp, artificial
  synthetic oligo
tgtttgctgccagccagcagttcaggaagaacacagctccgtctctctgcagccagatgaaaatggacctagtgaagtcaggtatcaagatcctcatgcctaagagccccattaagcaggacgcagtgaatggctttcagagtgagagctccaaaaaactggaccccacagagcagggtcaggaggaatggtagtacccaaagtggcagcggaaaagccagacaaagctttattgggccctggtactgagcaggccaggatggggagcaagcctggatacacctgctagtgcctcaggtgcatggccccgtaagtgcagccatggccacaggcctactcgttaacaggaaagctacatctacattcatggatgcattaacagccagtgggacaaccaacatacagacatctgttacagcagtaactgtcagcaaaaggaaatttattgacaacagaagagaacagccttttaacaaacgattgcatttcagtgtgaggcaaacagaaagtgcctaaggatacagagttattgtggccgggacaaaagatggcttcacccacatcttattcactagatcaacagggaataactcagtaaatacagctgtaatgaaaaaagtctaccagctctgacaaccactgctgattacagcaagcttgtactgctcagcgcctttaacagtgtcttctgttgtggacttgactttatttattttatgcagtgtttgacagatgacagaaaaagagaaagcattaaaatgggagaacctatcagaaacgtcgtgaataatctatggccatatcactctgaaagtgacagaaaaaaagaaagtgttaaataggcagaagctaacagaaacttcgtgaataatccctggccataccacccgaaataggcacgatttcttcggatatcagaagctaagcagtatctgccctgtatagtgcatggacacaaggaactttgtgaatactattactccgttcaaaaaacctgttactgaagtaaaagaagttatctgaaacatcatgaataatctatgaccatacgaccctgaatatgatacaaaaagagaaagcattaaaatggcagaagagaagctaccagaaacgtcgtacataatctacggccatagcacagtgaacgctccaatctcatctggtcactgaagtacagagtacacgagattgcgcccagggtacggcctcttcagtacttggatgggaggaacttcgtgaaggctatcatttcactcaaactgaatattattgaagcagtcactatcccagccattcgactagaagcatccgtattgcccctttatgatatggtttaggctaatcaaaagacttggtttccaacaacctcttctacctctgagcagattccagacagctgatttaccattacgtttccgaaatcatgggacgaccagctgcaagcgagacgatgctcagtgggttgaaactgatcacacagaaggcatttggcaacggccttctctcccagctgtttgggtcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacacggaccacatcgggttccagctgagaagaacaccattgcttccatctgtccttatccattctcacagcctgaaacaagctcactggtagcttatgcttgcaagcaggactgggaacattcacgctatttattcgggagtactgactccagaaagtacagcaaccttggactgctcagcgccattggtagggtcttccgtggtgcacttggccttatttattttttacgacatttgacagaggacagagagagagcaagcattaaaacggcagaagctactggaaacgtcgtgagcaatctacagtcataccaccgtgaacgctcccaatcttgtctggtctctgaagtacagagtagatgcgattgggcccaggttggggcctgtttcattgttggatagaaggaacttcctgaatgctttgttccgcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcactgggttgaaactgatcacacaggaggcatttggcaacagccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggatccagctgagaagaacaccattgcttccggctgtccttcttcattctcacagcctgaaacaagctcactggtagcttatgcttgcaagcaggaccgggaacattcacgctatttattcgggagtactctggataaatcatcccattattttggaaatgtaatgctaggtcaggtatctggaatcttcctggaggtagaagagggtattggatggaaggaacttcgtgaatgcgatcattgaactccagaaagtacaccaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaacaagtcagccgcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagacgatgctcactgggttgaaactgatcactcaggaggcagttggcaacggccttctctcccagctgtttgagtcctggaccttcacttaggaaattggtggctcagatcaagaagcttgtctcatgtaatcgaatagtgctggaggaatccaaagccttggtgtgctgcaacatgaagaggcatctggaacaggccaacgagagaacatgtgaagtactgaagaaaatctggggttgtgcccaagggttggactccatgtgaaaggacttagaaaggaagatgaatgagtttccattgtcaggctgcacactgaccacatcgggttccggctgagaagaacaccattgcttccatctgtccttatccattctcacagcctgaaacaagctcactggtagcttatgcttgccagcaggactgggaacattcacgctatttattcgggagtactgactccagaaagtacagcaaccttggactgctcagcgccattggtacggtcttccgtggtgcacttggccttatttattttttacgacatttgacagagtgcagagagagagcaagcataaaaacggcagaagctactggaaacgtcctgaacaatctacagtcataccaccgtgaacgctcccaatattgtttggtctctgaagtacagagtagatgcgattgggcccaggttggggcctgtttcattgttggatagaaggaacttcctgaatgctttgttccgcttaagctgcgtattgttgaagcactcaatggcccagccattcgaccaggagcatccgtattgcctctttgtgttatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacaatgaccacatggggttccggctgagaagaacaccattgcttccacctgtccttatccattctcacagcctgagacaagctcactggtagcttatgcttgcaagcaggactaggaacattcacgctatttattcgggagtactgactccagaaaatacaggaagcttggactgctcggcgccattggtagggtcttccgtggtgcacttgggttatttattttttacgacatttgacagaggacagagagagagcaagcattcaaacggcagaagctactggaaacgtcgtgaacaatctatagtcataccaccgtgaacgctcccaatcttgtctggtctctgaagtacagagtagatgcgattgggcccaggttcgggcctgtttcattgttggatagaaggaacttcctgaatgctattgttcagcttaagctgcgtattgttgaagcactcaatggcccagccattcgaataggagcatccgtattgcctctttgtgatatggtttaggctaatgaaaatacttggtttccaacaccctcttctacctctgggcagattccagatagctgatctaccattacgtttccgaaatcatgggacgaccagctgcaagtgagacgatgctcagtgggttgaaactgatcacacagggggcatttggcaacggccttctctcccagctgtttggaacctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacatggggttccggctgagaagaacaccattgcttccaactgtccttatccattctcacagcctgagacaagctcactggtagcttatgcttccaagcaggactaggaacattcacgctatttattcgggagtactgactccagaaagtacaggaaggttggactactcggcgccattggtagggtcttccgtggtgcacttggccttatttattttttacgacatttgacagagggcagagagagagcaagcattaaaacggcagaagctactggaaacgtcgtgagcaatcaacagtcataccaccgtgaacgctcccaatcttgtctggtctctgaagtacagagtagatgcgattgggcccaggttcgggcctgtttcattgttggatagaaggaacttcctgaatgctttgttcagcttaagctgcgtattgttgaagcactcaatggcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagatgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttcgtgtgctgcaacatgaagagggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatggggttccggctgagaagaacaccattgcttccacctgtccttatccattctcacagcctgagacaagctcactggtagcttatgcttccaagcaggactaggaacattcacgctatttattcgggagtactgactccagaaagtacaggaagcttggactgctcggcgccattggtagggtcttccgtggtgtacttggccttatttattttttacgacatttgacagagggcagagagagagcaagcattaaaacggcagaagctactggaaacgtcgtgagcaatctacagtcataccaccgtgaacgctcccaatcttgtctggtctctgaagtacagagtagatgcgattgggcccaggttcgggcctgtttcattgttggatagaaggaactttctgaatgctttgttccgcttaagctgtgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggctttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggatttagaaaggaagatgaacgagtttcgagtgtcaggctgcacagtgaccacatcgggttccagctgagaagaacaccattccttccgggtgtccttatccattctcacagcctgaaacaagctcactggtagcttatgcttgtaagcaggaccgggaacattcacgctatttattcgggagtactctggataaatcgttccattatttcggaaatgtaatgctaggtcaggtatctggaatcttcctggaggtagaagagcgtattggatggaaggaacttcgtgaatgcgatcattgaactccagaaagtacaccaagcttgtactgctcggggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaaccagtcagccgcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagacggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatcgggttccggctgagaagaacaccattgcttccatctgtccttatccattctcacagcctgagacaagctcactggtagcttatgcttgcaagcaggactgggaacattcacgctatttattcgggagtactgactccagaaagtacagcaaccttggactgctcagcgccattggtacggtcttccgtggtgcacttggccttatttattttttacgacatttgacagaggacagagagagagcaagcattaaaacggcagaagctactggaaacgtcgtgaacaatctacagtcataccaccgtgaacgctcccaatcttgtctggtctctgaagtacagagtagatgcgattgggtccaggttcgggcctgtttcattgttggatagaaggaacttcctgaatgctattgttcagcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacacggggttccggctgagaagaacaccattgcttccacctgtccttatccattctcacagcctgagacaagctcactggtagcttatgcttccaagcaggactaggaacattcacgctatttattcgggagtactctggataaatcgtcccattatttcggaaatgtaatgctaggtcaggtatctggaatcttcctggaggtagaagagggtattggatggaaggaacttcatgaatgcgatcattgaactccagaaagtacaccaaccttgtactgctcagggccttaggtagggtcttctgtggtgcacttgaccttatttatgttttacaacgtttgtcagaggacagaaagagaacaagcattaaaagggcaaaagctaccagaaacatcgtgaacaacctacacccataccactgtgaacgctcccaatctcgtctggcctctgatgtacagagtagaggagattgggcccaggtaggggcctgtttcatagttggatggaaggaactttgtgaatgctatcatttaacttaagctgtctattactaaagcagtcaacagcccagccgttcgactaggagcacccatattgcctctttgtgatatggttttggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggttccagctgagaagaacaccattgcttccggctgtccttatccattctcacagcctgaaacaagctcactggtagcttatgcttgcaagcaggaccgagaacattcacgctatttattcgggagtactctggataaatcgtcccattatttcggaaatgtaatgctaggtcaggtatctggaatgttcctggaggtagaagagggtattggatggaaggaacttcgtgaatgcgatcattgaactccagaaagtacaacaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttgaatggaaggaactttgtgaatgctatcatttaacttaagctgtctattactaaaccagtcagctgcccagccattcgactaggagcatccgtattgcctctttgtgatatggtttaggctaatgaaaagacttggtttccaacaccctcttctacctctgagcagatcccagatagctgatctaccattacgtttccgaaatcatgggacgaccagctgcaagcgagacgatgctcagtgggttgaaactgatcactcaggaggcatttggcaacggccttctctcccagctgtttgagtcctggaccttcactcaggaaattggtggctcagatcaagaagcttgtctcatgtaatcgaatagtgctgaaggaatccaaagccttggtgtgctgcaacatgaagagggatctggaacaggccaacgagagaacatgtgaagtactgcagaaaatctggggctctgctcaagggttggactccatgtgaaagtacttacacaggaagatgaatgagtttcgagtgtcaggctgcacactgaccgcaccgggttccggctgagaagaacaccattgcttccagctgtccttatccattgtcacagcctgagtcatgctcgctggtagctcacgtgtggaagcaggactcggaaaatccacgcta

SEQ ID NO: 1441 - DNA, 1500 bp, artificial
  synthetic oligo
ccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgaga

SEQ ID NO: 1442 - DNA, 1300 bp, artificial
  synthetic oligo
aatctccctaaatatcaaaatacaaaggttatggaataatatgtgcttcgaatagcttaagtggttaaaaaattctctttgcagctcaatattaaaggaaaaataatagactgttcttggacaaaaatgaaagggatcacgaagaatgtgtttccagccagcttcctgcactggggttattgcaccaggactgtctccctagtagaggccctgtttactatgttgcttagtccttgcttcacaaaagcaatatttgaaccaataatcccacaacagcatgacattttaacttgtaagactttgggttttcacaacatggtgggagtctgttttggtattttgttctataaattcagttggggctgacaaaattaatgaactggcattttagagaaagtgacattgtaacttcccctcctcttcgcatgtttacatccacactgataaagatgcaatcttgtctgtagctcattctccaggaacttgagtgtcaaggacagtctgcacggcccttgggaaatgggcattccctggcattgagttgttaattggacgctgagtgctcgagctgcatttatggttccatatgtgggtgtatgtttgtgtttcagtgaggaagatagtagctgcttccctcccacagccttgtggaccctggctgcacatttgagttgcctgtttgacgctgtctgaccctttcttagccagtttctggagctccctgggaagaatgagggtggaaagctagaggggagtcctgggtattggaatgcaagccagtggatctgtagcctgctgtgcttctgggcacccaacacgacacacaaccgtgtgtgttcccacagaacctctgtgtgtgtctgaagccctctgggtgactccacctgtggccacagttgggagcaagcctgcctgggcctccgcctcctgcaaatgtgatagtccccacccagggtgggtgcatgtgcctctcacggtagcaactccatggcttgcctgaggtgggccaggttcttcgggggctaatgtctcaccgccctgtccagttctggttctcagtgaatgtgttatgccatcatgacctttgtcactttcttccccttgccttgtttttgcacattggaatttgcaagcgggtctgtggtcatccgaagttgtgctcttcatgcataacctggcctccacgcctcactgctgggctcggatgacacaggtgggagacttctgaatattagaagtttattggaacatctaaattgtattctaaataacctttttctttttttgacaggtatcattt

SEQ ID NO: 1443 - DNA, 1450 bp, artificial
  synthetic oligo
agtaagctgaagacttaaatcaggagtttttctgtgtgtgtgtgtggtttttttttttttttttttttgagacagagtcttgctctgtcacccaggctgaagtgcagtggcacgatctcggctcactgcaagctccgtctcccgggttcacgccattcttctgcctcagcctcccgagttgctgggactacaggtgcccgccaccacgcccggctaattttttgtatttttagtagaggcagggtttcaccatgttagccaggatggtctcgatctcctgacctcgtgatccacccgcttcggcctcccaaagtgctgggattacaggcatgagccaccgcacccggccttaaatcaggagttttaaggtcacgagctggctgggattgggttgttgccaacacccacggcagctaaaaactgcttaagaaatgcctgcttgtgggacttgcagggagcctgggaattcacaacccctaccatatagtagatcaagccttgactactaaggaaggaggggttatggtaatctgcaggaaagtatctcagtagtgacgaactcatcatagtatgtcgtatagcctttgtttcttctcaaaacttttacagcaagttcaggatggcttcatccagacacccgagttaagcaagcaagcaagaaacaaaaagccttaaataagagaagttgaagacagtgtgccccttcgtgcctgaatttggctaggaaaacattggcatgggagcgccaccaagggctggcacattctctgggccaccttcagaggtttaacttctgtgtgagagaaaccatccactgggatgcagcttttacgccacatactgccggattccacgtacagggattgtccaaaagaggcaaatccagagacggaaaggagattcgtggttgcctggggctgtggtgggaatggcttaaggaatacaaaggatcttttgggggtgatggaaagggactaagattggaccctttccttccctgtcgcacgtggaaggaaatcagaaaccaagcaagagagctgggggtatgaaaggaactgtgtcattttcttgactgaaatttcaccaggtggcactgggtgttgagatacatatcactgagcaatatcaggtcacacaatacaggagtattgtttctgtcacttccgaattggtgtgcttgaccccaacagctattttgtatgcattatgtgggcaaacccaagtgggtattgttgggttttcatagcaacgaggcagcagggcagagacgcgtttttttaccatcaccctctgtggtgtgggtgcattatgtctgagccattggtcatcttttcttgtcacccacatctccctgggtctggaatctgaccagaaaggaagccgcatttgctcatctgacaagtcctaaggtcagagagctcccgcctccatgaaactatcactgtggggc

SEQ ID NO: 1444 - DNA, 3900 bp, artificial
  synthetic oligo
ctgggctcaagccatcctcctgcctcagcctcctgagtagctgggaccacaggtgcatgccaccacgcacagctaattcttttatttattattattatttttgagacggagtctcgctctgtcacccaggctggagtgcagtggtgcaatctcagctcactgcaacctccgcctcccgggttcaagtgattctgctgcctcagcctcctgagtagctgggactacaggcacgtgccaccacacccagataatttttttgtatttttagtagagacggcgtttcaccgtgttagccaggatggtctcaatctcctgacctcgtgatccgcctgcctcagcctctcaaactgctgggattacaggcatgagccatcacacccggccaattattttatcttttatagacatggggtcttgatatgttgcccaggccgctctcgaactcctgacctcaggcatgagccactgcctccagtctgtgtgtttttctaaagaattcttagtggctaaggaaggttaagaccttcctatcgtctctttcatctttccccagagatgagccattttgaacatggatttggcatctgtgccgcctctgagcccatgcttggctgatctgtggttggcgtctgccttccagagaattccttgttttcccacagtccctttgcagctgtttcatggagcacggggacgcatgctggctgctgccaccagctctgatggctatgaaggtttgagacgagtctcataggtgaaatctgggctctaagacagcccaccttttgaaaggacaattcagccaccagaatatcatcttcgatctgctggttttctcattttggtttccaaaagcctttagccattgttattattccgtgcttgtcttggtgttagctcagtatccatgaaacccgacaaacctctttctagaatgaggccggcaaaccagtctcataatgttcaaccccagtgaagaggaactaaacctcaaaattgttgtaccacaaactctattggccttttattggtggggattttgtttttattacaagaggggtgactgctacagtggcctttccggcaccaggccgtgcctgacggatgagaatgctgtgtcataaacagtcttttgcaatgactaaccgtgctgggttggaatgcagtgcacaccaaaggaaggtaggacttttagtggttgtcacaatagctgtgcgaatccaaatatggctggaaaatgtcaacatactctccagattatcagctccgacgaatgtaagagacatagtgttagggggatgtctggataagttgaactctaatcagagggaaaagggggttggaggaataatgaatgagggaaacacttttattgggagaatagcttgcaaaacggccagttgcataaagtgtcctgtcctaagaagtcctagtgtaagcctcggccagtcctaaaatatgaatgagacctaggacttattttacgtattgctgttatccttactagcacttttggagtctgcattctggtaatgcctaaatgcttgtgctgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattttagaggctgcccatgtgggaccagggctgcagcttccctatgggggtgctggtggccttgtggcacttgctaagctgggcgggcgtggctaggagtttgagcagtaaccaaagtttcctctctgctgagtgctcctggggtccatccctctggggtgatggcaggcagctttacacgtcgccttagagcatgtctttatttgctcctggatcaagaaccttttgccatcaatgtagggctgagcacccccaccaccacacatgccctgtccagatatctcgctctggggtagaaggaggcagttgtgggaagaagtttcctcatcacattagctctaggtaatttcagagaactttgccaatctcttccctagcttgtaggtacaatgaagataacaccagcagacaagataggatactctttcttgagtttaaaaggcatcaaaatagttgcatgcaatttagcaaggaatggatacattagattgtatttaagagagtgcctgttgctgtacagtttttaacaacacgttgaagcagagcaggtacctctcagatactgttttggtggggaggattggggacagtggtttcctgctgtcacactggggagaactgaaggagagaacactgctgcacctgagcggagactgacacttttgaggtgagcaccctgaaccttgggtgtgtattgtccctct

SEQ ID NO: 1445 - DNA, 1200 bp, artificial
  synthetic oligo
aaaaaaaaaaaggcatcctatcatatcttggcaccctcgatgtcaaaatgtggtaaaaaggacctttgcccattgtgttatgcattttagctctgttcagaatctgtcactgttacctacgcttattttgtttttagaatttgggggcagaaattttttttatctgtcatggaaaatagctgatgccccaatttttgaactcgataaaaatcccaactattcccatattaatccagatagatagatagatagatagatattgcatcagattttgtccctaaaaggactgagtacagtacaggatgtggagtgaaacaaggctgctacggtttcagaaacagctttggagctgagactttgccaaggaaagtgggaactgctctgcgccaggaagaagcgatgaacccatccttgacttgtacgaccatcgggtgtgtcagccgccttgtcgctgtgctctgcaaactcttgcccaccacgaactaggcacacgcttaactcagtgttgtggcagatggatgactaattcgggttttaacttggaaaagcagaggtgggcagattccaccatcctggcagaaggttgcatacccgccaaagcgcactaaaaatcttcctaagttactcggctttagctgaggctgagtgctgctgtctcagaagaattaattactttgaatgggagtcattttttaaagacttaagaatgtttccttttttttttttttttttttaaagcaaaaccgaatgaacttgggggaaataaatgctttgcctttgagagttgtctgctggaaaaagtcaacaaagggcttctgggttttgttcagtggtgtcttgattagagtggcataaatcttaagtactttcagaggaggcttacaaattagagaatagtttggctgttttggtttgattctaacaagagttcagcatggagaaataataccactgatgagatgaggaatgtgtttagcataataaaaaaactacctccgtgtagccccatttttcgggcagatgcaatttgtgtcttaaagaaaaacataaaaacagccagacattatcatttttctttgcttgttcctcagacgcattaatagattatacccctcaatctattgggattgagatgttttatattttaattacacaagtgaacaaagttttgctgtttagaactattctgttgagtgttgg

SEQ ID NO: 1446 - DNA, 3550 bp, artificial
  synthetic oligo
tggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccagaatgcagtggctgacgccagggctactcagctccagctgtgcgagcatttaccttttccagatctcctagtgtcctctgttagaggtatttggggacaaagttgacaccttcaaggcaatttaaactgccatattcccgaaaacccacatttttcattctcgttctcgttgccataatctctggctttaactgagtttccccttaagtagcttgctcctaccttcatactcagcaaagaacttggagggagaaactatggaaaatgataactaacgcctctgacatggaaatgtgtggtttatgtaaaagcttaaaatgacatacagtagccacttttcaaacactgatggatgacctttaatatttatagtatttgggtttttttagtattctgttttttatttgcaagtattttcaaggattgctctgggacaaaatgtatttaaaacacattaagtgattgcactttattaaggtgagagttttgatggtgagagttaatgtccagctttctagaaaactgcatatttcttagccctgcttcaaagtgaacagtctctttctctcttgcacctaccccctttgaaagctttttctccctattacatctgcacttgcacatctcaaagaaaaaaatgttccacaatgatagatgcagtttctttttaaaagaatccagggtgggtgcggtggtgcatttgcagttctagtactttggaagaccgaggaaggatgatcacttgaggccaggagttccagaccagtctgggcaacaaagcaagaccttatctctacaaaaaaaaaaaaaagaaaaaaaaaacttaagacaggtgtggcggtgcccaaggaggttcaggttgtggcgaactgtgttctcaccactatactccagcctgggcaaaagagcaagaccctgtctcaaaaaaaaaaaaaaaaaaaagaaccactagtaatttaatacaagatacctaataagtgcatggaaagaaggctgctggtttgctctgtggcgtcccagccctgaaaatccacacagatgctgtgagtgtttatttccactgttggataccctggcttgtggctattcagcatgacctctgagaattccatgcttgctctgtcaggagcaaagaatcccaggctctgacgagtactagagcttgaggcttcaccgctgtaatttgtgaccagctgtattttattttatttcttttggccaattgtgccacacggttttacaggcttcacgtaggagttgtttcctgcccagaacagaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatct

SEQ ID NO: 1447 - DNA, 1650 bp, artificial
  synthetic oligo
actgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttg

SEQ ID NO: 1448 - DNA, 1200 bp, artificial
  synthetic oligo
caacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggt

SEQ ID NO: 1449 - DNA, 2150 bp, artificial
  synthetic oligo
tagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagc

SEQ ID NO: 1450 - DNA, 1050 bp, artificial
  synthetic oligo
aattccagctactcaggaggctgaggcaggagaatcgcttggacccaggagccggaggttgcggtgagccgagatcacgccattgcactccatgctgggtgacaagagtgaaactccgtcttaaaaaaaaaaaaagcattacctgcaggtgatatgagttagacaccagttctagggctggtggggagagagaaattaggagcccatacgaatgttggagtggaccctgcaggtgtattagcaaacatacctaccctccaaaggctgacagagcaaaagaggctacatgatgaagcaaatgaagcaactaaagggtggtggctgcagcgacctcaggacctaggactgacacctggatgagcagggtgactggtggaatgtgggaacagaacagaacattgagggagggcctcagaactggaaaccatggctaccgtgttgatgagaactcccagctgcctggaccaagaagccggtgctgaagaactaggcaggacgtccgagaggagctgtgtccatgtcggccccgctggccaggtgagctgactgccctcccctcaagccaccggttcatgcgaagaccacgtcgctaggtagcggaggttcattccctctttattgtgtatttatttttttattgtggtgaagtatatgtaacataaaattgaccattttagccatttaagtgtacagttcaatggcagtaagtacatgtaattgttgggtaactgtcaccactgtccacctccagaactttttatcttccccaaatgaaactctgtccccgtgaaacatgaactcccctttagttcccgccagcccctggcaactaccacctactttctgtctatgaatttgactctctattacaggtacctcccatatgggtagccagacagtttttgtccttttgtgactggcttctttcactcagtgtaatgtcttcgaggttcgtttgtgtggtagcctgtgtcagaacttcctttttgagactgtggatagaaatcgtatttctggtgtcggtatagaccacatttggcttccattgtc

SEQ ID NO: 1451 - DNA, 1100 bp, artificial
  synthetic oligo
acctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctcttta

SEQ ID NO: 1452 - DNA, 1250 bp, artificial
  synthetic oligo
aaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttg

SEQ ID NO: 1453 - DNA, 1000 bp, artificial
  synthetic oligo
tcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatg

SEQ ID NO: 1454 - DNA, 1050 bp, artificial
  synthetic oligo
cttttatctctctcttattctctctctctcaatcattttaaaataatgctggacctaagttgctaatgatgaaattgctatacggatttctagttccatctttatcagggtttagaataaagcttatgccagattcataaagttcattgggaatttttcgtattttgtgtcttttgaaactatttaaatacatagcaagcacctgtttttttaaatgcttggtggaatttagctctaagattattatggcctggtgtataactgttagatcattgccaattactttttcaatatcatctatgattattgttttacttttttcatgttttctactcttttctggccaattttggtaattcatatcttgccaggaaattataatttccctttaaatactttcgcttttcaattgtcattgagtcgcataatgccctctttatagaaaacttccatttctatggttatatatccattttcattcctgacaaaaaatatagaatatttttcttgagaggaactcatctattttatttttattttttaaaagtcaagattattgaggtatactttatatacagtaaaatttgcctttttaagaatacaattcagtgagttttggcaaatgcgtacagttgtgtaactaccactacaatgaagataacatttctgacaccctcaaaagttcccttaggcccttttgtaatgaaccactagccccactggcagcccctggcaatcactgatctattctgtgtctccataattttgctttttgcaggatgacatgtaaatggaattatagaggatgtggattttacttagcataatgtgtttgagttcagacacatatgagtagtatcttcctttttattgctttacttgtgtctttatttatttgatgtaagactttctatgttatctaattttttctgtttttgagacagagtctcactctgtcgcccaggctggagtgcaatggtgctatcccggctcacagcaacctccgcctcccaggttgaagtgattcgtctgccttagcctcccgagtag

SEQ ID NO: 1455 - DNA, 1100 bp, artificial
  synthetic oligo
tctgttcattaccactgatctcccaccatgaacttggggcttcacttccgcttcccagtgaaggtcaccctgtcccatatgcactctttgtcagaatttttttattttgcaggaaataagggaccctggcatggatggagcatgtgaaactatcaagaacagtgaaatgtttcagatttttgctatttgccagtttcgtttcatgaatgctggcagaagacacctgaatcaaagataaaggctgtttttactcaaatggtatgtgtttcatgttctgttggttccccttgttctcgaagtcctacggagcatcctaggtccatgtttgcacactcaggagatttgcatcatacctaagcaactccaagcttaggaaatctgaatcttttataatggactgcaagttagcctgcccaacttttgccctggaggaagacattgtctttaatataatgaacaacaaacaaacctgccttctcccctggcgcgagatactacctctatctcccaagactgtttgctatacaaacatcctggggaatagtctggaataaaatcattcagtgctccagctcacaagaggtacaaaaaggtgatagatccatggaaaattatttcctaatagacacaattcttatctcctcctggggatatggccaatagttgttactagaaatcagatcatcactggactttctagcagttaccacagaggcagaatttcatttggcactgaatgacccttgagtcatagaagactagaggtaaaaggagcctgcaagaaagtgataagaacttccttaccaacggctccaagctccttatccaaccaccctctgacatcagctgttgtacaaggaaaattggcagaaagcaggtaagcctcacccatagattttgctcaaataaacagagcccttaatgtccttcatagtcccaaaacagcttgggtctggtctgcaacttcagctcttcactctgaacctaagctaattttaagagtttggtgcttgtttcagcagcacatagactaaaactggaatgatacaaagaagattagcatggccccaatgcaaggatgacaaattcatgaagcattc

SEQ ID NO: 1456 - DNA, 1050 bp, artificial
  synthetic oligo
agtagacattttgcaatgtgctgagacatttttggttgtcacactttgggggcatgggagtgttactggcatccagttgcttaaggccagggatacagctaaacatcctacagtgcacaggacagccccacaaataattatgaaaccccaaatgtcaatagtgccaaagttgagaaatcctgacccgggagaatctagactggatgttggggaacatttgggattgacgcccacagagccagtgtatgtatgtctgtgtatatgtatgtttgtagatttacacacatctacatgtatattgacaatgaagacagatcatgcccctatttaatttatgcaaatgcaaaggcaatggaatatgttggaaaaggggagaggaatttaaatagtcttagcaatttttcctgatacctaatgtgtctattcctaaagtgaagttaggtgttggggcgtgcatctgccatgtcttgagcaagtaacaattctctgagtgtctcagagtataaattgaagcccagtctaatgttcggatatattttgcacaacacagtttcttttttgctctcaatatttcagttaaggttcaacaaaaaaggcagcaatcatagatatttttgacaattcagtcatgtaccaagataggcccatattatgtgtgagaattttacctgggaggtattgaacacacccaaactggattatgaagtatcttctgcactttttgaaaaccaatacaaatgagacaccactacacacctaccagaatggctaaaatgaaaacagggacaacaccaaatgctggggaggatgcagagaaagctgggtcactgatacatttctggtggggatgtaaaatgattcagccactctgcaatacgctttggcagtttcttacaaaactgaatgtgtacttgccatatgacccagcaattgcactcctgggcatttatcccagagaaatgcaaacttacagtcatacaaaatcctacacacaaatgctcatagcaactttgtttgtaatagctccaaagtccttaaacaagttgatga

SEQ ID NO: 1457 - DNA, 1750 bp, artificial
  synthetic oligo
aaacttgggaagtttaaggaatcaacccaaggtcacagagttaagatgtggcacgttagggtctttactcgagggtctctgatagtgtgcttctaagtctactgccgggagtgattctcttactaaatagtagttttatcattgtcaaaaaaacccatcaaacatcgttgtactagacctggcattttctttctttctttctttcttttttttttttttttttttgagactgagtctcgcactttggcccaggctggagtgcagtggcgcgatctcggctcactgcaagctccgcctcgcgggttcacgccattctcctgcctcagcctctagagtagctgggactacaggcgcccgccaccatgcccggctaatttttttgtatttttagtagagacggggtttcaccgtgttagccaggatggtctcgttctcctgacctcgtgatccgcccgcctcggcttcccaaagtgctgggattacaggcgtgagccaccgcgcccggccttctttttgtttttctaaacagaggatatgagcagacattgcacaagaaatgcaaatagaccttcaacacatgcagagacactcaacgtcactcagaagagaatgcaaagctacacagagatgccgcttttcagatatcagataggcaaaggtgcacaagttggacaatgctctctattgatgaggctctggggcagtgctctcacacaggctggttagacaatgttatttatttatcaaaattagaaactgcatttgccctttggcccagcaatcccacttctggggatttttaatacagatacatccgccccatacaaactgatgaacacaacgtttttcagtgcacattgctttaatggcaaaatattggacacactccacgtgactagtaggggaagggtcaaatcaattatggtacatcgtcatagtgcaatgatatgcagttttgttttgtttttaaagaggaagctctctgtggactgttatggaaagatctctagggtatactctaaagcagaaaaaagccagggtgaagaataatgtatgtgaaaggccactatttgtgtaagaggagggaaatatatttacatttgcctacaacaagcagaaaaattgctgtagaaattgatatcacaacaggagacacatggtatactataattcacaactttgggcagcttgggaatgacgatgtttacataccaattagggactcaagaaatcctataaagtttttcttcaggatcctagtattcaaattagcataaggatcagacatggaatataatctctgaggtgaatgtttcaaacaatgtttgaagccccctgggatcacacaattaggagttgtgcctatctcaattactttcatactgtttctttacatgatccaatgctaatcaacaatttacctggttaaaatttagttggtttggttatgctctgaagaggacactcccttcttatgttttctgcactcaggcaggagacttgtaaaggagctaacaacaaagggatttttaaccttcaaagccttaattagaaaataagagcaaatggtacatttttaaagaggaaccaggaatacatattcttgtgggcttttgcctcattacatttgttaataaggaatgccaaaacatgtgcaccaaaaagcgttcaaggtcttttggtagtaaattatacttgtaaatttgatgtaagttgatcacttgaagaactcacactctttgaagattag

SEQ ID NO: 1458 - DNA, 2100 bp, artificial
  synthetic oligo
agaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatctaacagctctagttctgctaaaagcttaactagctaagggccttaaatccttgcattttaagagctccctaacagcattaaaacatttggaaggtgcaaaattatttcagccagaaaagttcaacactcaggacccaagggtatttttaaaaggatatcttgcactgaagccctacttttgcaaaagactggaaaggaaaccaaattgttatgagtaacaccttaactaaaacgaacaatccagaaaggagggtgttacctacctcatctgcatatagattaactgtatattcaatttaagaaaaataaatcttaatgggaacgtgcacacaatttttttgaaatgcagcaaatgaacaagaatctttacctactgaaggcccgaggcataatttcaaataacactattgtcatagaacaatacacactgacattttgttcagaaaaaaaaaaatttagtgcatccacctttctctatggtttggcttccctacagggttgatctgttgaacttattaacagggacaagctggacatcaccttggcaggattgcaggagagctggagaagtagttggcttcttagaaacaaactcagaccaaaaaaaatttccaaagtttgctttcttaactccatataagcaataacttttttcaactcttagccaacatgattttaatgtaaatctaccttctggatttcaagaaagtgcaagttgagcaaagagtactttgtgtagaactaatggcatattttcccccaagaaatgaccgcaattttgtgacgataattcaataaagattttaaatgtgttggtatcagaggaaaaaaaattacttagcaaataatgcattggtggcttcaggagtgtcagctgcatgggttcaatacatgtgagctctgcccagttctgtgaaaatttggtggtccgataactgggcctggaagcccataacgctagccccctgcctgagtagcctaaggagccacctagtgacacaaactgacttcagtccacttcttgtacttttccttgagagcccttcatatgatggagttcaggatttctcaatctcagcactattga

SEQ ID NO: 1459 - DNA, 1900 bp, artificial
  synthetic oligo
gtgtacacattctctctctctccctccctccctctttctgtgtgtgtctctctttctctctgtgcacatgcgtgagaaagacagagacagtgagagagagagagagagagagagagaaataatacttagaagtattgaaagtttgaagacctctcatctagtctcttcaactaattaaatgaaattaatttgtattgtaacttatctcccttatgcatacccatctatttgtaacttgagaaagactatattcttaattgttgcattgcaattgttaaatttattgcaaccgaagacatcacatttctctattgcatatttttatctccccagtcatgagacagtggatgtcctttatcctcacctccccctaattgtttccctttggtacacactctttccttccttcaattttcataaattcaatagtcaggacccagagagagcaagaaacaaatagatgctatgtggaataaaaccattacttcctgacacctccatatttgttctttctggtctcttggagtctcccaattagttcttgtcttaattttctggcaaatttcaggaaccctcacaatcttcaaactatcatcttccaatattcttctcttgggaattccctggaaacttcctgccaatatgcaatcctaggacctgagtaagagccatattttattgactatgagagtaatcttccagatggcttattttgtaacattccgcaagctataggactcagtacgtataggcatgtctccccaagcctttctaatcagtgggctaaggagagacattgttctattcattataccatatgccaatcccttctcaaatctgggatcataattgatgggttttcttttttccataggccaagcttttgtttcatggctctcatgttcttgagcagccccattggcctcaagccctcacttaccctaacagttagataatatcacccatcaaggagtcctaaaatgcagtccattgacattaaagtgatagtctttgctgtcctaaagcttatctgtgctggacacatgcacagcctggagggcaaatggattgttcagcagcttgccagggagagataaataagcagtgaaggaaagagcagaccctggcagggcaaaccgaactgggcaaatccataaagctacagccagtgagcaaacaacagcagtcttatattcagtcactggaaatgtgaagtttcttttgacctaatgtgttaatgtgaatctatgattcacacagtcccgaaagacaacacattttgcagcaggccgaggaacttttgttataatgtcatctatggaaaagatcaggaaagcagaaaatatgatctttataatgtttgtgtacctacagggccaattatctattaaacaatcatatagagtgatcatttcagggaaacactaaaagagactttaaaaatagtcagtagattccagtgatttacgtcataaagaaacagaccatcttaagtaacacatggacataaaagcaagcagatgtttgcattctaaccagggcactaatggaggtgctgtggcattgtatcaaagtaaagtttgccatcttcagaattgcccactggagttttaaatacagctgtataactttgagtcaacaacttgtaagcattccccgaccactctgagcatcattctttgctgcaggtaagaattaataattcatcactaacacaccgtgtcaaactcattttctgaaacaggcctgaaatgtgtgattgactataacatgaaaatttgtcataaaaacaattccttgggttgctgaattgtaaacataagttattatgagcaaaatcacagtaaaaataaatgagcaagaccaaactcacaagagactggatttgaaatttcacatg

SEQ ID NO: 1460 - DNA, 1450 bp, artificial
  synthetic oligo
aaaaaaaaaagatttcgccttcagatatctgttgtcacagaaatatttctgttctttacacagcatttgccacaatttggaattactgatttactactgttcattatcttgtttccagatagaaacttctatgtcagtcttgttcaccatttcatccctagcacctaaaatggagctcagcatagattatcaataaacggttgttgcatgaatggacagagtggagaaaaacggtcagattaatacagttccaacagatcaatggttgccagagcctgagggtgaaaagaggggttgactacgaaaaggcagaaggaagagatttggtggtgggggtgggggtggggggtggtatatatagaattcttctgtatcacaattgtgatgttggctacacaactttatgtatttgtcaaaactgatagaaccataccctccagaaggtcaattttactctatgtaaattaaaaaataaattaataaaattatgattccaaaacccatgtcaacccagaacaaatctaagattccaagattcacaggtttagagtttttttgttgttgttgttctggtggtggagggttcagttaacttcctgtgttcatggtcaaagtactgactcaaaacatacttccctatttttcatttatcagtttaaagaaaggaaaccggaaacaaaataaagatgtgaaagataaataatacaagaaaaagcacagtagtaaaataatatttaaactaatcatgtgataaaatgtcagcatttattcatgacatttggctctgtttgtattggatcaccccagcagggcagtggctgtgggttgatttcataatagtgcctcccacatgtacgcccacgcctgacctctgctttgtgcagttgataatgactaaacttcacatattatgctgacaaaatctactccttccctggagggctgttacacacagggaattggagtttcacagctgaacaatgtttctttctcaaattctgggatgatccacttccattagaacaaagttatacgggctgataaattgctgtcttttgccaaagtgttactcatcatcgtatattcacccaacagatgccactgagaaaccccatcctatcagggggaaagaaggatgcagagatatgaatagactgtttagacacaagttgcattccctaaagtaagcacatgacatacgaatttcaccttatgacatttcccccacccccacccccactgactttcatccattagaacgtgttgatggatataccatttcaaaatgaaatatttggatatctgactctgatttggggaaaggggaaatggtgagctaatttcctcttttatcaagctgaatcactaagttcgctctgttgccatgcacgcataagtaatgccatagcaacctctcagtttgctcttaaacacacaacagcagaagtat

SEQ ID NO: 1461 - DNA, 1000 bp, artificial
  synthetic oligo
ttgatggggctaagtttctggaagtgacagatcttgtgcttgtggctggctaatgaatcacccaggaagtttgagagaccaggatgttacctccagattgtgggacttccaggcttccgccctatcaggcaggcacatctgcttctccagatgaaggaaacaaaaccagaatagaagagtcagttggcaaagcaacaaggtcaattcttgccctctccttcctggtttcctgcactgacctggaactatctacgtgaactgccttcaaccaattctgcactctgcaaaaagaattaaagcaggaaggactacactgttctcctctttcagcatccctgaaatgccgtctgactcatttactaaacccacaagttttgactgatctatactgtgcattagactctgtcctaggcactggagaaagcatggtgatcgtaaaatagttttcctatgtagcacagattgccgtgggtcttgcatgaggactaattgttaataaggattcttgttgtttatctaaacggatgcatctgtaaatcttgcttgagcatattgcattactgtttacaaaagggtaaggttgctgtttatttttcggcatggaagatgcacacattgtacttttcatttacaagatacagctcagggtgaacaaagccctaggataaatactcttttctaaaacacacaaaagatgataaactccaaagcttacatgtgttctaattttcattatggcccatttggcccagggttccatatctgtcagaagatccccgtgacatattagggagggcatggttttggctatcatctaaaatagcattcttattcctcctccaattctaacttcccaacctgccttaattatcacatttggattcatcttccatgaattaaaatattagactatatcacttcttaagatacaggatagaaatagaaccaggatgcttgcaatttatgacttccatgaagttaactctaattttatgtttcc

SEQ ID NO: 1462 - DNA, 1500 bp, artificial
  synthetic oligo
gtttcctcatttgtaaagtgagaataataatggtgtctactccactcaaatgagcttatttattagtcaggtaaggttatgctggggtaacaaattaaccatggagcctcactggcttaatgcaatggaaacatatttttcagtgatgctgtgggttttcgggggctctacttcttgtagttactaatggactccagctgagcgagggtcctccaaactgagatgccaccatcttaacagattgcttagacagagctggagggtcatttactttcttggccagaaagtaatacatgctacttccattcacagtccatgctgcaaaaccagtcaagtgatctcacgtaactcaagctggttgggaagagacaaacaaagaaggagcccaccctgtggaaatcttttcatatacagagaagagccagtatacaggctgtggggaaggaattactgacatgttcacgaaagagtaagaagctcagtgtgacagttgtgtggtgactaaggacaagagttatagaagaaatcattggagagatagggaggggcaagatcacacagagtgagcaaaagcaagagagtgagagagacagaaagtgctgtctgggtcacctcttagactcgtagccacacaaaggggggagctatctgtgtttgtcacttctatcccccaagtgcctaacacacttgctggacactcagtagaacctcagacactttgtttactgaatgaatacatgaatgaggtggtggggttgacatacttgtctctctgaatttcattccccgggcctctctccaaggtacggactgcttcttgaccatcacaacgaagctttggaaacatatttcagggatgatgaagcaaacattatcttgtgtacaagacagttcagcagaacattatcaaggaaaccacattcctatcttgtaggctaaggatggagctgaaagatgtgactggactttagacttcctgcaggcagcaactcttccccactgcagcctctgctggctgagaaacaggggcctctctcaagaagaagcatatcagatctgaccagagactggccagaaagaacaccctgcagactgcctgaagcccagggctaggagggaggctgaaggagggacaatagcatctctggaagtcaaaatattttcttttacccagctgccaacttgcagagaaggaaattaaagcaaggctgctttcctaatttagagcgaggatattttccatatttttgtagagatattttatttatgagacacaaaaggaaccaggggatacagatagtaagagtgtctactggccttttaatgcacggtaggctgcacatttccttcttgtgctttagaaataggttcaataaaagaaagtccaacttgtgaaatcacacacatctaattctctttgagatttaaggccacaagttgtgacctgagctgagtcacagctgggtcgaagggaactgcctcatctcttctccacccacg

SEQ ID NO: 1463 - DNA, 1200 bp, artificial
  synthetic oligo
gccaagcaagttcaactgcaaagctaaagaatgtgccaatctcttctttcaagactttattcctctttgttttcactgctcattttcttcaatacgtcatcacaagttccttagacctacctttagataaaatgcttctgtttccttaactataatgagcttcatgtaaggagcaacaccaacatttatgaaaaatttgtcttccatttcttctaccaagttaaatacctggccctaaagtaatctgggtggccacctggtctggccatgtcattcttcagatgctacaaagagacatagtaagtgagctggcttccccatctatccacggcaaagtcagaaccggcttccaagcctagaacaatcttctgactgcaccaccttcatccctcacggttcatctgttatctttcagctttcttaatcttgtttgccaggtcgccacgcatcactcattactcactgatcttcgggtctatgatccttataactgcccatgccattacatactttataaatcagatactctcactgtcccttcccttttctacagaacttacttgtctacctttttatccctttaaataaaagaataatgatacccaattattgagcccgttgttactgtgttaacatgggctttgcgtgcaactctaattttgccctctcaatacttgtatgaagcaaaaaccacaggagataaggaaacttaggctcagagaagataagtaacttgctaaagttcccaagacactctcattttatgcttcaaccttctctgtagagtagcactgtccaatagaaatgtgatacaagccatatatgtagtttaaaatgttctggtagtcagataaaaaatgtaaaaataagtagttgaaactgactttttaactatatatttcatttaacccaaatatcccaaatcgtatttcaacatggaattgatgtaaataaataattattaataagatattttacattgttacagcacatctcaatttggacagtggattttcattagaaatacttgatctggacttagacttcataaaatatatgattgcaagaatagattcacatacccaagttgttccaaacgtacttaaaacttttccaaaaactgaacacagcatcacttttttaaaagtttaaatttcacttcattgcaaattatattaaattaaaatgaattcatcagtc

SEQ ID NO: 1464 - DNA, 1050 bp, artificial
  synthetic oligo
tcctggcctcaaatgatccacttgcctcagcctcccaaagtgctgagattacaggcttgagccactgtgtccagcttaatattttttattgaacattatcttgtgcatgttttctcacagggctaaatattcttcagaaagatatactattcttaactcatttatgtttgagtaatattttgcttgactcagtgtttttataatttttcctctaaaagtattagcattcacaaagttgggcttctttgatggtttaattcagtgtttctgtgattttcaattaaatctaaatttactctaaaaaatgtctctaattttctgtttcctagattcttatctttattttctgcattacaagcaaagctgagggcctgggatggtggctcacgcctgtaatcccagcactttgggaggttgcgggggtcagatcacctgaggtcacgagttccagaccagtctagccaacatggtgaaaccacgtctctactaaaaatacaaaaattagctgggcatggtggcatatgcctgtaatcccagctacttaggaggttgaggcaggaaaattgcttaaacgtgggaggtggaggttgcagtgagctgagatctcactactgcactccagcctgggtgacagagtgagactccatctcaaaaaaaaaaaaaaaaaaaaaaaaagcaaagctgagatttataaatttgtaaagcactccttgctgtgtaaagcagttatcacagtgcttgggcacatagatttcaatgaaagctagtcaatatcattcttaggattttcacgattattctgcttgaaacttcagctttgagaataaagcaaacttcatcaaaggagtatgtagacatagttaattttcacgtgttactcccagtcagggtttctcaacctttgcaggactgaaatttggaactggacaattctttattgggggaatgacctgtacatggtaggatgttgatcaatgtcactggtctctactcattagagtctagtagcagcccccaacccccaaaacagttgtcacaacgaaacttatc

SEQ ID NO: 1465 - DNA, 1050 bp, artificial
  synthetic oligo
cctgcctccccactagggtgctggtgtgggaggagtggattaacagccattgagaatgtggcaaagcgtttctacaaagcacatcagaatacactagagagctctgcagtgggaacagatgatcacgaaagagagaatgtggagctcagacatgctggctgtgacctgtaggacttcatgggctggatccagagggttttcatggcaagctgaaagtgtgaggatagacttggaatgctaatcctactccatgagcaaagaggctgagagaaatagccccatcacagagaaaggtggatgaaagggtgaactggatgcagttattacagatccgatgacagagataatctgtcctaaacagaaatgagtgtcgtgcccggccgatggcgtcctgcctatataaaataatgatgcggtgccttggaggctgaggggagacctcaactgaagtggaaggaaaggcagttcaacaagtagtacaggggctttggcaggaaagttaaattctacgagctgggggcgctgaatccgcccagtgtcctatacctaggagtgaaagcaagaggcctgctgtcttgctgtctttgtgcctctcttcatatctgctttttcttgcttccttatttctctctcactcactttttctctttcaacaaaaacacatccttcctaactcaatgagaaaaattgcttcatccaacacttttttttccctataagctccaaatctatgtccaattgtataataaccttattgtttcaagagagttttagtgaggccttttctcaactcccatctgttttaccctcctgtaaatttacgatttcatctagaagcaactttttactggatctctggcacttttcattcagtcttagcagtaatttccacttgaattttacctctaacactaatttacaccgtgaacccaaaacttaatcttcctgtaattttcagattgtgagttcactgctggtaactgaggtaactggtaacttaactagttaatgttaatttaccagtttaacatgtttaattgtctttaaatg

SEQ ID NO: 1466 - DNA, 1050 bp, artificial
  synthetic oligo
tgtttagggattaaatctttgtaaaccactgcagactggcgaaacagcatggtgaactggtttctcaaaaccataaagttatccagagctcttctagagcgtgaaacaaaaaaccctatgcatggaaggaaagaagaaagagtttactgggaattcattctatcttaagtcagtggtccataaagtgtagctcctgaaccaacagcatcagcatcacctagaaacattagaaatgcaaattcctgggctccacccgaactactgaatcagacactctggggatgcagtacagcaatctgtgatttaacaagtcgtccaggtgattctaacacacgctcaagtttgagaatcactgtgttaaataattaacaactgtttgttaattattacattaacaaatttaaggtacaatttaagaacaatgactctttcccgcactaaatcttacctttaaaggaaactacttaaaacatgcacatgcatttaaaacctttgaaaaattgaaatctgcactgagacggtgactgatatttccaaaagagatgactacaggttgcattcatttttaagagagatcttagcagactggactttcagtatcatgaaacataaaggaaagatgtttcataagacaaaagaaagctgagcgcaatttgaattgcatttaacctggagaagttctttatatgccaaagaaaggcaattttctgccccacatttgcctaacagaagttcaatgtgattgcctcatagagaccctttaactaatgctgattcctccttaaagggcaggtttatcttactgtttcttccttgtcaagttaggtacattttcatttctctagccaaaataaagtgttttaggcgttgatttaggttggatctacactcaaatatttttttttttttttttgatacggagttttactctgccacccaggctggagtgcagtgacgtgatctcggctcattgcaacctctgcctcccgggttcaagtgattctcctgcctcagcctcccgagtagctgggactacaggcgtgcgccatc

SEQ ID NO: 1467 - DNA, 2000 bp, artificial
  synthetic oligo
aggtgaaagtggcagtggcgcaattacggctcattgtggcctctatccctgagctcaagagatcctcccgcttcatttagtgattttttgtagagaccccacctctactatttttgtaggtcccgtgttacccaggctggtctcgagctcctcggctcaagtgatccacttgccttggcctcccaaagtgtggggattacaggcgtgagccactgcgtccagcaaggcttcctttccctaaaaaaagaatcaccacagaatttctgaagataaccaacccattttctatattttacattattccatttaaaaattcaattctatattcatcttcttcagcaatcgtttttgggtcgaagataagcacactgaaatacttatccaagccattggttttacatttttatacttgcccatccagcagacaataaaacagaaagagaaacttttcaaaacccaaagagatccccctctctcagggctgctgtgtacgggtacacaggttgtgcactgtacaacttcaggaggcacacaccatatggacagtaatgtgaatcatagcccttcattgatgcaacaaggtgggactgctctggtgctaggtgttgcagaagaaatagagaagcctgccttcacttgtgtttctaacatgagtgctggtgacccacgagctctgtcgtgaaacaccccacagccaactctaacggttatcacttcaaagccagtgctgtttctcctgggatggcttcgtgctgcttctaggtcatttttccagtcatataaaatgcgtatctttcttttgtttttaaaaatactttctctgagaacgttttaaaaaaagatttgttccagctcatccatactcaagagaacttcatgttttgtaccctaaacttgaaaaactcagataacagagagaacgtaatgtttgtgtttactccatgaccctttatgaaccttcagtatcatacttgcctttattcttctgagcaaatgctgattctgcttgtattcaaattcgtgtttgacctcttctgaaatatatgatcagtattgtgtttcaaatcgccttcgaagtgtacttacttgtgagtgcaagcctctcctcagctggagatcacacgcagctccttgggagggaagggggtctgggtccaattggattgcttgccctcatatagaacacagaactcataaaaatggatatgtgaggaagagaggtgctaaactcatcatggccagtggtccttacatttcttactgcaactagctcttcagcaaatgctaaaagccatctttcaagatcccgagtctggccaggtgcagtggctcatacctgtaaccccagcactttgggaggctgagaccggtggttcaaaaccaacctgaccaacatggtgaaaccccgtctctgctgaaaataccaaataataataacaaaaataaaattttttaaaaatcccgggtctgcctgtataccccgacaccatcaccaccggggatcacatagactactttttccttctctgcttctcttaggtgcctagaacatcggcactctttggggtttcaaacgttcacttctaacttggcttttgtttcttttttgagatggaatttcgctcttgttacccaggctggagtgcaaaggtgtgatctcgactcactgcaacctccgcctcctgggttcaagcgattctcctgcctcagcctctcaagtagctgggattacaggtgtgcgccgccacacccggctaattttgtatttttagtagagacggggtttcaccatgttggtaaggctgatggcaaactcctgacctcaattgatccacccgcctcagcctcctaaagtgctgagattacaggagggagccaccgtgcccggccctaacttggctttctaatgtaattcttttaaatccacttggtctttttaatcttgtgttagtatgtccggtttgattgtttctgtgttttttatcttcaagctggcccaa

SEQ ID NO: 1468 - DNA, 3350 bp, artificial
  synthetic oligo
tcccatctctacaaaaaaaatactaaaattagccaggtgaggtgacatgtgcctgtggttccagctactcgggaggctaaggctggagaatcacttgaacctgggagacagaggctgcagtgagctgagatcatgccaccacactccagtctgggtgacagagtgagaccctgtctcaaaaactaaaaataaaataagattttttttaatgcacaataaaaattagaataataccaaaacaatgatgatacaataaaagcctttctccagaagaaaatgaaaatataaacatatttctaaaataagtattatttgggaggttaagctaaaccagcaaatctcaagctacatatggttacaatttatatgaaaaagaaaatttccaaccaacggcatctgaaccataaatctagatttagacaattccactgttacttgttttcccagggctgcattattcattttagaattggaattttctttaattctctaaaatacaaggcaggaagcagattcgttgccatgtggaagagtgcaagtcctttgactacgtgggtctctgtccccgacctcaacgctgccggccatgctctgttgagcctagttcaggatcaagagcttcagaataccctccatcttaaggcaacatttatacagacctatttgatatgctctttggtttttttctcttcaacagtaaaagcacactccctcttcaggaggataattaaatttctccagtcccatgcacgtcctgagctgcattgcaggcccaggttaattggagacaggcagctatttgccctctaatttaaatgagtcctaaggctgagaggcatacaagcaaaatcagacacctacaagagccaacagaacaaacggaaaggtgtgcttagggcatggcctaacagcaaacacaagcacagtcgagaggataggacaatcgacatttggcttccatgggcagaaaatagagaccactggagcagacagcagagaggagaatgttgccccaggaaaagggggcagcctctacccaggggcagacaactatggctagatgtgcaggcaggatgtatgttgccagatcttctggtttttcaagagatgtcaaagatttggtgtttatatggagttttctatattttaaaagttaagaacccagccaggcacagtggctcacgcctgtaatccctgcactttgggaggctaagatgggcggatcacttgaggtcaagagtttgaaaccagcctggccaacgtggtgaaatactgcttctactaaaaatatcaaaaaaaaaaaaaaaaaaatagccgggtgtggtggtgcgtgactgtaatcctagctactcgggaggctgaggcaggagaactgcttgaacctgggaggcggaggttgcagtgagccgagattgcaccattgcactccagcctcggcgacacagtgagactccgtctaaaataaataaataagtaaatgtaaattaaggactggttcagactaaagacaacaacacaacattgctactcagaccaaagagaacagaactgcaagacgctggtttcctaattgtggcatagagtgatgttttcttcagggttgcatttctccccaaaatataaattgagaccaatgtcattctttcaaacactcttctttaaaggaaatatcaaagaaataaacctctatactacatgcaatgtaggatcctggattggatcctggaacagaaaaaaagaccatagtggtaaagtagtgaaatctaaataaagcctagagttccgctaatagtactgaaccaatgttcgtttcatactttcaacaaatgtgctgtggttgtgtaagaggttaacattgggagagactgagtgaaagatatatagaaactacaccatctatgcaacctttctgtagatctaaaaggattccaaaataaaaagtttagttaaaataaactatatggaataatatgcgtgaaatatggcccatcaattaaattataaaacacacattaagcaagttgtctgtgaacatcaccatagtaagtatagtaagtttatagtaactaaggaagaatgcacaactaggttctggcatggaattggggacaggacagtagggagttgaaatgccagaaagaataagataccttaaggcaattggtaaaccaatgtgagcaggtcagagagactgggaggggaggatttaggtgaaaacctgaaagaaacggagagcaaactattacagacctgaatttcatgtagagagggtagacaatgacattgctcatttattttctctttacttaaatattgttgtaaaatcagtcaaaataaggcttctttactcatctatggtttactactttcccagctgctaattttaaattagcctcccctctgctgaggatcacagttaacaaaatacaaggtatttacaagcaaaagttaagcacaaataaaggcctagctgaaaatgaaaaggagagaactctaaaccacaatgacacctatacacatgtggccatttagtctgtacaatttgcctatagcagggcttctcaaccttggtgctattggcatctggggctgaatcatcctttgttgtgggagcttttctatccattgtaggatgtcttagcagcaccctggcctcttcccactggatgccagtagcattcccaagctgtgacaaagagaaatgtctccagacattgtcacatgtcccttggcaggcaaaattgccccttggctgggaatcactggccaagagaaaagtataattgtctaaatcagagaggatattccacaggtataacccagtattgccactcaagtttttagaactatctggtggaaccatatgaaactactgtttttgtaggttaaaagtggttgaacatcagtgatttcataagtttcaacctgaaatgtatatacttctatatgaatcagtaaatagtaaaatagcaattgttattagtggtaaaaataacttataatctgcattataatatgaacttgtttgtttaaggtaattgccatgtcattgaatgtcatgatgaccaatgatgacgtatggtcttctggtagctgtgtgacccagaaaattataaaaatattaaatatattaacataccagctaggaaaagtggcaggaaaatgttttttattaatttgctattggttcatcagaagctgaaagtaaattcagcactgaaaatagtattgttactcttaacatatattctctgctgattagataagaagtcacctctgactgcttcaaaggcgggccatgggacatggcacaggtcatgggacatggccctctgacagcttcaaaggtg

SEQ ID NO: 1469 - DNA, 2050 bp, artificial
  synthetic oligo
gaactcacagggttgctgcaaaggcctgccatagtaagtgctatatacatgtacaatattgttatttcttctcttaattgctaccttattccagaaaggatttgagacaactcgcttttattggcccttgcttaatttagacactcacagtaaagttaagctcagcctaatttcaattacttcatgttatttctttcatcagaatattatccacctcctcccccacaatgtaaatcctttaccccctttaagaatcttccatctccactattacaaaacttccttcctcttccacctgcatcctgggtgtggattcctgtgctccttatctggccttaactcctcctctgcttgaattatgtatgcagtatccagctatcttaagctgactgagggcaccagatctttgttcttatttccagaagtgactgatacaacctgcatgaaaaggacgttccccttggcagcatcagattacatggaattaccaagagaaatcaatgtaattccatcttcaccttgcctccgaagaaagctttaatgaccaattttcacagaaagaagctagtttaatattcatcttcactgaattcaagcgagttttgttttgttcaggttttcattttgttgagtatcaatatggactcactgatttttacatatttggtacatttcaggcaactaaatttgcattaatttttgatgttcacactgtcctacctttaatcaatagtagccacttcttaattaattaattaattttgcttttgagagacgggggtctcactatgttgcccaggctgacctcaaactcctgggctcaaatgatcctcctgtgttagcctcccagtcgccaggtttatagatatgctaccgcgtctggcaatagtaatcattttaaactgggacctttatccttctgacgtattccccatcatctttgctatatctgagacaagatgttctagttcacttcgtccgttcctgacccagaccttgaattggtcaaatcgcaagaatacttggttcctttccatggaaaacaatattcaaaaaccaatcttctgattctggaaattggtaatgaaagggaagaaaatttaaaatttttctcttgcttctctagtacaaaccttattttagggtaatcaagtagcccagaagacgaagggaattccggctaatattgtacacagcaaagattaatagaattagaaagtttgcattttgcaaggctaaaatgcaggcttataacgctgtcagcaccttaaaccagtgatctatctcaatattgtatcaagataacctgacatgttaatacgttagatgtgataatggtcttggaatcataaagaaaaatgtctttatctctctttttaagagctttattgagatacaatttatataccattacaattcacccatttaaagtgtaaaattcaatggcttttattacgttcacagagttgtgcattcatcataacaattttaaaacatttttattaccgccccaaagaaatcccacacccttttgcttttagccctgccatccctccatcttcccatctccctaactaaccctaggcaacccctgatttattttctgtatatagattttcctattctgaacatttcatgtagatggaatcatgcactatatggtcttttgtgtctgtattcttcacttagcataatgtttttcaaagtttctgtagcacatatcagaatttcattctttttaaaagctaaataatattccattgtacaggagaccacattttgtttatccactcatcagttgatggacatctgggttgatttcatctttcggctattgcgaatagtgctgctgataacattcatgtaaactattcatttgaatgcctgttttcaactctcttgagcatatacctaagagtggaattcccggctcatatggtcactctgaccatttgaggaactgctagatttttccaaagcagctgcaccattttgcattcccaccaacagtgtctgaggatttcaatttctccacatttttaccaacatt

SEQ ID NO: 1470 - DNA, 1200 bp, artificial
  synthetic oligo
gtttaatcagagtgccatttttttttttgttcaaatgattttaattattggaatgcacaatttttttaatatgcaaataaaaagtttaaaaacttagctggtgtgtctgtttggtttctggaaggatcgcggatgaaacctttgcaaagaggcctacctcttggtccattggggagggacaagcatctggtgactggataaattcccttatggcatagaaatgggtttcacccaggtatgcaaaataccttgtctatactaggagatcattttctcaggctgattgaattcctagtatgaattgtgtgagagctttaataaaaatatctttgcagttcttacgggttttgataagctgacattgcacgtgctcaagaaaatgaaggtgataatttacagcacagtatcttatttcagggtatcaaattgaacttggttatttaaccaagtgctagcattaacatagatgagtaaaaattacatttttagcagctgcgttaagaaggaatttaggacttgagcttactcattttctaatggccggtttctaatcagagttcaatatttacaattgctttaatgaatacagttaagattagtgaacatgattttaaatttattgggtcctcttcatttgaataatctttggatttaaaagatacttattcgatcttttgggtttaaaggacactagcaggacacaggtgagatttgtactaagtttaaatccagcgggaattaattgactcacatttaggtctttgagtccttgataacttctcaatcatcggaagtagttattttcactgatgggtaaaagcaaagtccttggtgcgggaagacggaaacaacgtcaattttttaagagttaaaaaaagatttgccattctataaggtccttaatggattcctcggttctgtagggaagggtggagacttttttttttaaataagcaccagttttattaagccgaaacaacagcatttaagaaggctcttagttcactgaatgttctgcaaagctaaattttacaacgcaaatgtccaagaagttaaacatttttctctcaaaaccgatttatgaaaataccctttttgaagcggaggggtagggaaaattgttgatcactattaaattggttgctttcatttcctttgctcaacgcttattttgagaaatgcacaggaaaccatttacct

SEQ ID NO: 1471 - DNA, 1050 bp, artificial
  synthetic oligo
atcctttctagattttgatttgaattacattgcatttatagattagtttgagaagcatcatcttcccgatcttgtctttcctttcatgaacctgctatatttctgcatatatttaggccatcttacacatctttcagtactgttttgtatttttctccataaaaggttttgcataccttgtgtaaatttattcttaggcatcttttaggtcatataactgtggtaaatgagaactttattctaaaacattttctatgcctatcaacattttctccgctatttttttcttttatgttttatacctaatttttttttttttttttgagacgtagcttcactcttgttgcccaggctggagtgcaatggcgtgatcttggctcaccacaccctccacctcccgggttcaagcgattctcctgtctcagtctccagaatagctgggattacaggcatgcgccaccacaccgggctaattttgtatttttagtagagacggggtttctccatgttggtcaggctggtctcgaactcccaacctcaggtgatccgcctgcctcagcctcccaaagtgctgggattacaggcgtgagccactgcacccagcctgcttttatgttttatacctaattcttaaaagtatttgcattttattctttgcatgatgtgagatgtgaatataacactttcccccgagtcaattattttcaactctgacgaataatctcttaacccattggtttgtgagtcttcctttgttatctgttatcttctcatatatcaggactcttttttacaatcactttgttttcgttgatgatatatatccatttccatgccagtatatgatctcatttccgtagtttttaatgtgtctgtgtgtgtttgtgtgtgtatacatacacacaaaaaagtagaacaatgaaataatgtgtctctttctagaagaagtattaagaggcaggaagattgcttgagcccaggagtttgagactgcagtgtgctactatgattggacctgtgaatagccactatactccaaactgagcaaca

SEQ ID NO: 1472 - DNA, 1150 bp, artificial
  synthetic oligo
ttttttaaaaaaacttttgggtattgagcaatttggggctctccaaggattgtaatgattatatttatatttgtataaatattttcaaagttctttacagtttttctttagtatttccacttgaaagtgactacatatccccatgaggtaatctgagctgttattttatgcacattttacagatgagacactgtcccaagtcttcttaattctgtttagtgttcttttggctacacccagtgtgatggagccagatcctacccactcatgagagccaattgtgcatctctgcacagctcagcagtcacattatgttagtagcttgaaatcatccacagtgtgagcgtttataccatgagaattggcaaaggctacatagtccgtttatttgttttgttgtttccgttgtttatttcttgagtaccagttactaaacatttaatggcacactgctagatacctccaagaatgagaaaacttggggattaaaagacatttgcttagtctgttttgtgttgctataacagaataccatagacagggtaatttataatgaatagaaatttatttggctcgtggtttggttcaggaagctgggaagtccaagagcatggcatcagcatttggcaagggacttcgtgctgcatcatcccatgggagaaggtggaagagcaaaggagaacaagagccacagagcaagagggggccaaactcactttaataacaaaccaactctcaagataactaaaccactcccatgataatgacattaattcattcacaagggcagagccctcatgacctaatcatctcttattaggccccacctcacaacacttgcactgaggattaagtttccaatacacaaactttgagggacacattcaaaacatagcagatgcatgttacaaaacaggagcagaaacacaagttctctgagttcaagaactgaattctgtagatagattttttggttttttttttgagatggagtttctctcttgttacctaggctggagtgcagtggtgcgatctcggctcactgcaacctctgccttctgatttcaagcgattctcccgcctcagcctcctgagttgttgggattacaggtgcccgccaccatgcccagctaatttttgtatttttttt

SEQ ID NO: 1473 - DNA, 1350 bp, artificial
  synthetic oligo
taaatttttgtgcaagtgagtgagagcaaaaaagaaaggccgagacgttactttgcaatttgaatcagtgcctgtaggcactagactgaaagtcagaatatgagaaacagaagacaagttattatcttcttctcagggaagctgtaattaatggtgacttgactttatccagaagctcaggctggcttgaacagctgttttacatataaaaacggcttgcaatgcaggagaagttagggcaatgagaaatcaaagtcataatgcaagaggaaagtaagagttcacataggtaaagattgacggccaggtgtggtggctcatgcctgtaatcccagcactttgggaggccaaggtgggcggatcacttgaggccaggagttcggaaccagcctggccgacatagcaaacccagtctctactaaaaagtacaaaaattagctgggcatggtggcacatgcctgtagtcccagctactcaggaggctgagggaggacaatcacttgaacctgggaggcggaggttgcaatgaaccgagatcacaccactgcactccagcctgggcgacagagcgaaactccatctcaaaaaaaaaaaaaaaagaagagagattgacaacagatgagtcctggtgagtagcagccttagtgagttcatgtgtttcctattttaattgctctctactctctgaacatactattatatgacatcactttcaacagtgtcgttggcaagccttctctcactgtctgttggctctgctctctttcgtgttccctgcatcctcaggcatgctcgtcgtggccacaagctttgccaagttacgtcttcacaggatagcaaccctagtcaaaagagaacttttgtctcccaggagttgaaatccaagtccagggattgggtttaataaaagtgactttggtcttgcctgtccccaagtcattcactcttgtgtagaaaaccctgattgtccctgggagctagagtggtgtcaaccttacctaactcttttaaactggggagtggcacaggggcagtccctagaagacaaccgaggggaagggaaggaagctgggaagtacaaccgcagaggtccacttcagcctctcttcactgaggaagtggacgtgtctgctttcctgagaggcaggagcagtgtcccacgtgagccttcatttttagatgctcaagtatgaagccaagctgggtgtagtggcttacacctataatcccagcactttgggaggctgaggcaggcagatcacttgaagccaggagtttgagaccagcctggacaaaatggcgaaaccccgtctctgcaaaaattagctgggagtggtggcaggcgtctgt

SEQ ID NO: 1474 - DNA, 1100 bp, artificial
  synthetic oligo
gcaggaggtcgaggctacagtgagcccagatcgcaccactgcagtctggtctgggcaacagagtaagaccctgtctcaaaaaaaaaaaaaaaaaaaatctacttagggtttttgattaggttactaatgacaaaatattttgataattaatacatacttgcagcatgcataaaagtgcgaccacatgcagtaagcatgtgcaactaactacacatacatctaaatcaacttcatatttacaaactctagttttaccaccaataaattcaactctgaggtataggcaatgttttgctaacctgctggagagaggaccaagtatcagttaatctggcaagaatttttttctgttttatgcattactatttcctcaatgcctagaactgtacctggtacaaatatttaatgaagaaaaaacaaaaaccacacctcttcaatcaatgcttctgtttttctaactcattgaaaaggagtacatggctacctgacgacaagcatatagcccagcactgtctaacagaaacctaacaggagccgtattttaaatgttctaaccctgtctctaaaaaaacaaaactagtagttcatttaaaaagtaaaatgaaagaggtgaaatgtgattttagtaatatattttctttaacctcatatataaaaaatattatttcaacaagaaatcaatattaaaaggattaatgagaaacttggcatccttttttgcactaagtcttcaaaatcccatgtatatttgatacttagagcatgtctcgatttggacacatttccagtgttcagtggggctgctggctaccatattggatggcacagacagaaacattctctgttaactgcctcaatggcccatattaatgttactattaactcattcaagccaatcaaatttttgagtgcctgccatgtctcaggaaatattctaaggtttaggatacaaacagaacagacagatttcccttcctatccagaatttctattctagtcaggaaacatgaaccatgaacaaagtaaggagtgaaatatttgcagcaggtaagatgctgggcagtgctgtggagaggggttgtagggaagggcctggggtg

SEQ ID NO: 1475 - DNA, 1250 bp, artificial
  synthetic oligo
cttttcttgtgtgtcaggcactgtggtaagcattttttcattttttgtacataatttcctttaattccccaaacaatcctacaagaaaagtgttattattagattctggaattgagattcagagtttagcaacttgtccaaatttgcacagctggcaaattgcagaactaaacccatcccatttgtctgatgatgtatgttggtttctgctatagaaaaaatgatttctggagttctggtcaagattacatgcaacctatttgtacgcaaatcctgaatataaaaattctgtttttgaattgaggacaaataagctatgatccatactttcttcagcataagggctgagttttgttcagttttgttttccttttaacatctcatctaatgccttggacatagtagttgccaagtaaaaatgatttttagggtacagtgaaaggccttctaactacaactaaaaatgcggatgtaagaaaagattaataaatttgacaacataaaaattaaaatattttttgcacagcaaaaaatgatgtaaagaaaatcaaaagacaaagcgcaagaagaagctcttcttgccctatgaggagaagcttgccctgggagaagcaatttacaacaaatcttacagctaaggagctaaaattcctaccatgcaaaggacttttttagttgacttttaaaaggccaaaaatgctacagaaaaatgtgcaaaagtcctgagcagacaattcgcaaaaagagatgtaaaaatgactcttaaacttacaaaaagatgctcagcttcattcataacaaaagaaatgcaaactaaaactacactgcgacaccattctcagctatcagagtggcaacaactcaaacctgacaacatgttctgttgttaaactgtggggaaataagcactctcattgctagaggaaatgcaaaactgtgcaatatctatgtagggatatttggcaatatctaacaaaaccacatatccatttacccttccacctagcaatgccacttgtagaaatttacactgcaatacacctctaacgatattaaaatgcatatgcaaaatgttatttattgcagtaatatttgtcaaagcataggacattggttaatcaactatggtgcatccacacagtggaatactatgcagctaaattaaaatcaccaatgaagggcagctaaattaaaatatggtatgcctccagatgtgttaccctgaaaaagatacaatatcatctatatga

SEQ ID NO: 1476 - DNA, 2000 bp, artificial
  synthetic oligo
gtggacgtaggaaggacagaaagggatcagtcattcattctaatgtaacacgttgtcagaacaaagaatgtgtcagtacccaaatggatctgaattcatatagcattcatgtttctgccatgaatttctgcactggttactatattgggatgtcatctggggtcccatgtaagtaagctgttgcaaatgggcctgagagattacttgccaaatgacagggttgcccaggacttagtgaccttccagctctagcatcccattatttgcagtttgtagaagaaaaccgggagaacgtgaaaacccaaagagaagtgagggatcatgtcttaggaacctgcatccttccatcctgcttcgacttctcaactaaattcttaagtcctggagtgcaggtatcaccgaaatttgccccatgcctgaaatacatggtagtagatggtgactctgacaagcgtgaagtgacctgaatctgggggaagtttctgggtgaacagagagcgcggaggatgcgcgggtcatgctggaggcgggtcccagccagatgtgcacagcccgccccgccctccctcgctcaccccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatcggcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccagggcactagggcagccttccggcaacggaagaggttttctggttctctaactgtgatgtcttgctttctacttaggtgtccactagaatatggtttttccaccgcagcattattgacctttcgggctgggctggataattatttgttggggtgatgggctgccct

SEQ ID NO: 1477 - DNA, 2100 bp, artificial
  synthetic oligo
tcatcgacaagacaagagtcctggactaaatgaacttttttgtacctcttgcgttcttcgacaccaacatttttcctccaagggtcattagtccactgagggataagaagaattgatctagaggtacatttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagagactagaggtacatttttaaagtaatttacttttgtggtgggaaatagaaaacgaatgaaaaatagtaagtatagaagcctctctgaaatatttaataaataaactcatttagctttagataatggttgactgaggtgaaaaaattcaaaggggagagagaagagagaaagaaaattgggtatgtgtatattgcaccataagtcaccatttttgtaggtcacaaatggtccattattagcaatttatatggttcaacctaatgctgtagctgtaatttttgaatatcaaatttggacaaatctatagggctatcaggacaataccagtttttgaagaataccacaatgaaagcagaaatattagacgaacatggcaaatccatgtctttgggatctgtagcccaactgggtagtaataagtgtttcactaaagtggtctccgaagcaaaacaaaagcaacaaaaggtaattaagataactaccataacagtggaactgcttaaaacaatacaaatatagttcttcctaatttatcatcaaatagtagagcctcatgtgggttcattctggaagcattcacttactacactttaacactttttaaatgctccattttgtgagtaatttaattatcttccaatttggaacatattgcctcttatttgttttagctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgttttgtgagtgttatttttattttatatgttttatgaaaaatgaattgcaatttctcctggcaaatgaaagaagacaaaaagccggtttcacagcttaagtaaaatgggttgggtcttaagtcctgagaagcaacattctctgtaatgtctagaaacgaataccttctgcaaatacccaatcaaacctgctgctctaggaaccaaggaggggaagtcctgttcccctacttggggggtttcctatttgacacagaccttctcttctagcttccagccaaggaagcctgctagtcctgcaagggcagtggtttggctgcccagctctccatgaggcatgcccccaaatcaaagagaggctcaccacatggatctgctaagctctacctttttatttcttgaaggcacttttacaggcctagtctatgaaaatggaacctcacagttgtatggttgtgattttaaaagccaaaatcgacaaatgtaggaggacaaattttatagtggagcttaagttttctatgtgaactagagaactgccgtaactcccttttcactagttgctgtgcagaacccaccataaggctcagtccccccaggagggtttccatattaacccaccctgcatctctacactgagactttcccattcattctggctgggcatttgttgctccctctatattttgccttatctagtctcggctctgtgactggtggtcatatatacaaatgccagatggatttaaccaaaggaaaagtagacacaggcccacccgtccaa

SEQ ID NO: 1478 - DNA, 1250 bp, artificial
  synthetic oligo
attcccctgacttgtacaggaggctgaggcaggagaatcgcttgaacccgggaggcagaggttgcagttagtggagatcgcgacactgccctccccagccttggagacagagtgatgctccgtctcaaaaaaaaaaaaaaaagaaaaaaaaaaaaattcttggctcttgagctgtacaaaaacaggtagtaggtcaaatttggcccacagcccctagtttgctaacccctgtcttagactataagctgcttgagaaagcagcctgtgttttaatctttgcacctctagtggctagcaaagcccagctaggcgctctgtacagcaggtactggtaagtatttacagaaggatcaggacgattttccatggttcatgtatgtctttatggctatgatccatatttaaagacaaccaaaggggagcactgagaccacatgaaagttacctccttctatagtgggaacttggcatttgaaaaatcttcagcacccttttcacctttacactgatgaaaacatttgatttatttctgccagccatagactttagtttactatcaatagcatgttgaaggtttttatagtcctaactctaaattggtaaagccaatatttgtgtcatggaccctccattcacgctcgatacctggtagcttttgccaaatacaaggaaatacatcaaggcatggctctggttgtatatcaaacaatcagttatcagaggttcaactcaccattccactgatgcatcggccacaagcggttgttttaaactcaccgtgcagttctttcactgcacttgtggtgtaaaagccttctgccaacagaatgatcccatacaagaagaaaaaggacgcaattccatagatgacatactgcatcagttgtatcctacaaagagaagaagagatcctgaaccattaaattcactgcctggtagtgactacgtttctggacgctggagagaggacatgagggggatgttcctgtgagtgcgtcactcgccccactgatggctttgatggacttgtggggcatcctgggcggcatccctgcccatgtcccagcaacctgggccttccttccaaggtgggaatgatgtttcctttgctcagggcagcatccagttgtaatcttttaatccttacctgagtcctgggcggcaagggttagaatcctcattttgcacataagtaaaacacaggcattgaggagttaagctcctcatcggaggatacacagttagtggca

SEQ ID NO: 1479 - DNA, 3000 bp, artificial
  synthetic oligo
ctaccattccagggatggtcacttcctgggagaaagctggaggcatctgttacttgggaacaacacaattctgttgagacaatcggcagcatcacctatcaccatgtcacagctccccatgtccacagctaccatgtgtggagtgtcctatgtgtgcaccttaccattcccaagtaacattccaccctggggcctaaacagctaccatattctaggccctttctttttccttctctcatgaacctttttctaactacataaagtgagctttaagtaaaagcattcatcttctgctaggaaagcacactgtagtctttctgaaaaacatcatgaggtggttgcatctcagatactttttttttaaacaaagtatcactctgtcacccaggctggagtgcagtgttgccatctcggctcaccagctcaccgcaacatccacctcctgggttcaactggttctcctgcctcagcctcccaagtagctaggattacaggcacgcaccaccacgcccagctaaatttttttttgtatttttagtagaggtggcgtttcaccatgttggccaggctggtcttgaactcctgacttcaggtgatctgcctgcctcagcctcccaaattgctgggatgacaggcatgagccaccacgccaggccttagatgcatttttaaagggaaccggatacttacacctcgctcagcaaggcatggtcactggcgttggtggagaagtgttgctcaagaatcgccacggtgcctgcgagagccacatgcccacagccgcagaataaggccaccccggagaagcagaggatggtggccaccagggaggcgtaggggactcctcccagacacttgatgcagcattcaaagcagcctgaacccaaaggagagaaaatatagccgttacgggcaagaacacctctggtcttcaagaataccccatattcacagagaaggcttacaattttccatctcccctctcaggctctatggttaatattaatacttcgacatcccaagggccagtgtggtagttaccgtgatctcacattctgcggtgaggaccctgaggctccaaaagggaatgtaacttaatttgctcagaatctggaagggtagtgaatggcagagcagtcaattgacaaagagttataaggtagttacagttctagagcttcctgatcgactgagtggtggggggagccccgctcaagtgccaacaagaagcactcattccactaacacagtcaaaagagaggacagcagtgaagctgcagctctgtgaagaaaagcaacagtcaggtcgtctccagcctcacagttctggggtttcaatacgtctgctgctgtggcaaccaacggctttccccaagccctggacctccggggcaactgggagaatctgatacagcaattatgccgtcgccaggttcaaacaaatagcaaggtgattgttttggaaaggtcacaggtattttggtccataattcagtgaagaacaaagtcaccaagagccactcaagtgggtctactcaagtttcattcaagttgacatcagaaattatctcaaatttttaataaaaatgcttccccccagcccagtcagcccaagcaattcattcacagtcctcctcctccccggcttccacctgcccccttccccgacacacacgttcagagtcagaacccagaactggtgggtgatatttaagtacttgaaggagaaaaaagaacagaagaaaaaaacaaaaccaaaatgaacatccatgaagtggaatgaaggagagacagccgtaagtcactcttaatcttgaaaagacgagacttgtattcatttttaaaataaacttttacttgagatgtccataaagacctgcctcaggggcagagccaggtgacgttttcagtttggagacatttacgtttcagtaaaggcagcactggcctcaggataatgtcagtacctctcctaacctcctgtctctgtttatattatccagacccttaagtaaatggcttgtcggggaaattgaactttaaacgcattatggtgtttagcagcaatcaagggcacttcattactttagggcaagcacattaagccagcaaaaaaaaaaaaaaaaaaaaaaaaaaaatcccccaaatggtcttcatagttgtcatggaatgacaacccagcataaaacaccatagatgaatgttttcattttagtgagcattccttttaaactagcattcgcttaaacctatggaaagtgactatgaaaactcattactagatttctctttagttcattagaaaataaaaaatatcagggcttcataagaaagctgtgcttcctttaatttcaaaagatgagcagctgtttttaggaagaccaacttccctgaagtggattggggaaactatataaaatgggaaccatcctggctaacacagtaaaaccccgtctctactaaaaatacaaaaaattagccgggtgtggtggtgggcacctgtagtcccagctacttgggaggctgaggcaagggaatcgcttgaacccaggaggaagaggttgcggtgagccgagattgcgccactgaacttccagcctgggcgacagagcaagactccgtctcaaaaaaagaaaaagggaaccagtgcacaatatggttcaagttcactagcaagtcagtatcttaaagagcttcagacacttgggatttgtgagcagagatgttagagctcaatcttattttgtcacatgactttctggggactgaggtgagaggaatgcaactcaaagtccaaattctctccaggttcccaaactaagagaaactagaatccttggccttgacgtatctcattataaagagaaaacagacatgggtattgtatcatccacaacctccccacattctcagcctctatgatcatgttaagaaaaagatgaatgcctgctttcctggctaacaaagttgtatctggttcttaaaggataaagatgtgag

SEQ ID NO: 1480 - DNA, 1900 bp, artificial
  synthetic oligo
aattcatataagcttttcatagacgtggacgcactcagggggtgagggtatatgtggcttatttgggagtgaacttcggcacccaaaaggacacagcctgaggaggtgggaagacctaagtggctgatttcagctactccccagctacttcagagtaattccagttacctctaagggtggcaaaagatttcaaagcaaaattaattttaatggactctagttagatttatatgaaaacatataacataagggacatttcaaaggcagcaaagaccagatgacactacttctcaaagaccgagaagtactcagtcttgaataatccaagtcagtgtccctacaatcagacatgtctgacagaaagcccgagatcaacactcaatactcatcgatctgctttttatctctgctttctctgtctgcctactctaaggtgagaagcaaaggtaagaccaaaagacaaagggagctgatatgtcacacacacagtaagccattgttacataattaggtgctaatcacagactaacaatatagcgcataaacaatggaacgttcaaaaacaatcaagaaattacttatatcgataagtatttgtttacagctatatataaattattttatatatatatatataaagactgccatagcagtcagtaaataaactataaaatcgttaactgctgtatatggcacttttttggtgaaaactgcaggtgctttgaaaatgaaagaattgatacatttcagaaaacaaaaggcaaagtactctaaaaatctcagggactttacggcatgagcctgagctacaacgtgcttccactgtgttcaccatttacctctatgtaatcagaaatatcttgagtaactggaaggcatcagacagactgagagcatccactggcttaggctggataagctacaaaagcttctgcaaccagcctctggggacagaatgataccaccagcagaacccacacggcacgaccagactgtcagttatggtcgacacccaactatggccagaggtggaatggtacacgcagaaggattaagggtttttcttcccccttaaaatacatttcaagtggtttgggagaagacctcgaacttagtggccttacaaccttaggttaggaaagagtgacactaaagaacaatgacaaaaatccagtagcatttcccaggacttatagctacaggtgtccctctacaaagcagatcagtgagagagaagtcccaggctcagcctagaagggggccaagggataaagtctgcagttcccaggagccagcctgtggttacatctgggcagacaaggtgcaacatgagttaacagcagtgctgggccctccgtcagtctgctacccgcccccaccccacaaccccgtggcgactcaggaatccattctctgtggtgcaaatcacaacacttgggcttcttgctaaataccaacactccagagggccctcctctcccgacatcctctgtgacagtccctatgtagagggtgtgctctttgtcccgacttctggaattatctgtggccattttaactgaaacatcagagcattttggatttgagaggcggaaattggtgatatgtgaagtgggtggttattctactccttccttgtgagactgaattctgaattacagatttaactgtatataaagaaccattcttagtccactaaaaatggcagcctatatttagtcacggcatcttgcatgtcattggattatattaaagagggagatgagagacatttgagaatttctcccaagcttccatcaactactttctcctctggccctcactttgccacaaagaaacaaacctttctcaccttcactgccccttccccaaaccccctcatgagacaagcaggtaagag

SEQ ID NO: 1481 - DNA, 3450 bp, artificial
  synthetic oligo
taaagctaagtttaatttacattcttagttcttaatagacactgcaataattatccaaagatattaattcacatgctattgggtattagccattgggcaataatgccccaaattaagagacaggcatcactccatcaccaaccactgaaaacagatgggaaaggagaaacacaggaaaaaaaatatatatgtgcataaaaaactctgcgtaaagtgacaaaatttacaggattaaatttaatgaataaaatcctttgctgaaaggcttaaaagaaaaacataaaaaacggatccaccagctcaagaattatataacacattctataaataattatgtcaagttttcaaatgttaatttcaatggaaaaataattttttaataaacttaaagttaaatctgaaggaatactgatgtgacaatcacgcagaaacatttgtggctatcattttatcctatgtgtaccttaatgatgatgggtgagcaaattgggaaactacaaagtgtcttgtgtgggctttgattttgtgtagccagcatatgaacttgttcatctaaatgcagattagataagccaccctccagatcaacaattatggtgggtcacacaacaatcacaacccctcttgctgtagatcaggaaaaacaaatcccctggcttgtattcttattcaagcatgtaccatacatgtcacactagcttctggtagtgtgatatttttgaattatttaacaagcagctagtgtttatacatttaggtaatttttaaagttccttcacaaattatcttttgcttctaattttgtctctaaaatcacaactaatgacttttcatatacgggttgtcagggatgtactagcaacctgtagatctgttattaaataagatttaattgacataaaataatagcagtccataagactaagtgataagatacacagttgtgtagtaatgattttatattggttatatgacctttgcttcctttcagagagaaatttaaaaaagggatttttttgcaaagaccaaaacggttttatctgccatggttgaataccacattaataaaaattaaaagtatgtactaagtaaaatcatcattttaggataaaatcgtgataggcttccttgggacaatgctattacattatcataccccgacaacatgcaatcaacttagtctctagtcatcatggaaaaaactttgatctcacttcttcatcttgataaatattcccaagagcttctcttatagctatttggtcattgatgaagattttttttttttaaagacacacaagaaaatacaggctgggtttttggtggggaggtgtagatttggtaagaggattgaactaaacaaacgattttaaaattaaggtgctatgtacttaatgccactgaatcgtatacttaaaatggtaaattttatgttatgtgtattgtgtgatacctaaaaaaattaatttaaaaagtaaaattgctctgtttaggataaaatattattgtgtaccaaagaaattttatataaaaacaagcagtctttaccccagcatactgtgaagctgaagtacatgtaattgccgtttttgtaggtttaaaatggttgactatcagcaatttcatatggttcagcctgtatctttataaataaaacgaagttttgtccccgtactggcgaattactctttagtgactatcagtggacgcaagggctgtgagaaataaccttagcatgatggctttttatattagagccactgcggttacagaatatgtttttgggcatttatgacagtctatgactttgagtgagggaaaattacaatgcagtgagatccattaacctaacagtggctgagccgattctatgggacatcaaacttgaaatcagtcattatttagaaaaaagagattaattttagttcctttctgccattttcttactgcaaaaacactttattctccaaaaaaccattctgtatatgaaaattgtggtacgttctaagattctctttaagaaataggacctttatcaattttcttccccccagtctccaagtcataattagcagaagatcccccgccctgcctttccatcagcactgggtgacagagctgatgtcccctctctgaagctccaactgtaaatgattattacatgtcgtagtcagggcctgatacaagaaagagcaatcatattagaataagaaaattagagaatgcccaaatcactacagcattagcggaaccaaagcagaattaacatgcatgcccctccagttcctcctcagcattagcagaaaactacacattccacgttcctggaatataacatgcaggacacaagacctaagttacgattaattatattaataaaaaaagacagtttccccaatgcatcagcccaaggtgacaaactatagacatccctctatgaaatatcacgtcggtagaaagatttggaacaggaatggattgaagaaaggctgctctattaacttaacatcagcccacaggaaaaaaatcaaccctgaaagcaagaccatgccatagggattgtctcagagccattttaaaagagagacaaaacccagctaaccctttttaagcaccccccagtgaaaagctttaaacaggctattgtcagagcgctgggtaccttttctctcttggctttgttcagtattttcctcggctgcagtttccatggctggcttcataccatccaccaaaaatgcttttccccctgttccccccaacacacacttgtttttcctcctcttccttttcttttggactcccctccgtctcttatttacacccgtctgattgagaggctctgttcttcactacagtagattacagtcccttccaagatgcaaaagtcttgtcagcgtcaatttcgctctgcctactggtccataaagacagctgccaaggggcaggcagccatacgtcaccgaggatcccagttagaaaacagccattcggcgcccggtggtgcctacagtctcaatgcggctccagtgggagttgggggtaggggggtgggggagaaggacctgctccccaccgggctcttcctccttgctctctttcttaagatctcaatctcgatctctctctctctctctctttctccccacctcatttcttctagccaagtacacccaatgaatgctaattaattctcccaggaaaaaatagatttgtgacatcagaggaggggatgtgaaggagaaagaaaagagccccctcccaccacgtgactttgttggtcgacagcaatatatgtcgtctctaaggagaatgcatgtctttgcataggcatgacactttctttcctgtgtggtccatttatgatgtatcagtttatttcatttacccctcgaccctggcaaaacatattcaaaggacgtgcccatagtctctatttactttcttaaa

SEQ ID NO: 1482 - DNA, 2000 bp, artificial
  synthetic oligo
gtagcctgggtaaatggatggattgtcagcagcaacccacaggaacccactagtagtctatttgtgtcagaagacagaaacacgcaagtatggaatgggaaagacgatgaacaacaaggaccaagaacagtctggagcccatgttgctgtgatcatacctccagatgggctgctcctcagtggtgactcgcagcccagtcacttaggagctgtacggacattgagcaactttcactctctccatgccaaaattccctaccacccgaacaggttgacatgagaatgaaatgcagtcattattggaaggcatccaacaggacctggcataaagctagttttcatgaaatgttagctcttttcccattaatcatcctctccagttgtaagattttaaaatgtcattaattttgttccttgagcaaatctacgccttcttgtgtggattctgaataaatcataagtagaacttcattatatgataaagtatttgtaaatagatgagactgtcttatcctgaaaataactcatttaatagagtgaagttagatggaaggtttagtccaaaagcttcacacagtcacttgttcggtaatgcctcataggtggtcctaaaaatcatcactctttgcaaaatgcacaataaaaaacacagggcttatgggaaaaatggggttaggaaagcaacactcaaaaatttaatcagtgacatttacaaaaagattgcaacctaataaaaatagtagcaccattttacacacattaaatagttaagaaatacataaacacaacaataaatgtgtcacttcgcctagaaaaaggcctgaagttggctgtggggtgggtgtcggaagggctgcggttggtgagttactgggaagggctggagggagggttacccgaaattggagggacagtcataacaccaggtatggacaggtgtggctcttaacacgcggggtaaactgaggtagctgtagacatatgaggttgtgccacgtgcgtgttttgtgtattctgacgtcatgtagttcaggtgggcgcagttttctgcattcacctaatgtttcagcaagaaaaaatggtattaagcaaatccaagattctgattatgcacacattgttcatggtttcaaagcaagcattacaggagaactatctgcctgctatattccaaagctgcttaacttttaaatcttggatagtctctaaaaaaagcgggatctattttctaaaggatgttttaattcagaatcagacccatcaactatagtctcaagcctgcaaacggaactctctagcccatttttctctgacaaggcttccaactaataacatttcacatcattcctgagtttccatagagttcaagtatttacaaaagtcacacaacatggtgaacgcaggaggaagctgcagagatggttctagacttacagagaggaggctatatgcaaacccctgtatgacttgcaatgtccctttgcctctctgagcctcatttataagattgttttgaggatcagatagcatatcttgaaattatctgggccaatatttgaaaaatattagttgaatgtaaatctgaacatagactgactcacaatcatgaagaaagcataatccttctctttctaagaggtaaggagcactgaattggaaacatccactactgcctcggcataaatggtcaagtggtcactgaggcagctaaaaaaatgcagagaaaatagaaaataagcatcccaaacactaagctagttacagacacaggaagatgtgagggaaagcagccgcttctcctaattcagagagaatttcattttctccctcaaggtttcatctgctctcatctccctggtttcttgtgttaccatctggaatgccccacttccttgtttttttttttaaaaaaaaaggactcaaacttccaagtctataaaaattattcttgctcaatccattccttctgtcgtggtgtttgaaggagcttcagagtcatc

SEQ ID NO: 1483 - DNA, 1850 bp, artificial
  synthetic oligo
cttgaatgtaaacttggtctttgtaatggtgcacatcaagtcatatttttcttatagaagaaatctgcattttaacatattaaggatttttattttcttttttattttcttatgttatgatatggtgaaggttggtttaagtaaaaatatctcatttcactttagttcaccctccaaggctcctcccgggcattttacctccactgagtggcactgtgggtcttccacctgttttatccgtaacgttttccacatgggatcatgacaggtgttaccttgttgactatcctcaatgaaggcagagtgccttgagggcagaaactgttacacgtcatcactagccaacacagagtacaattgctacacagcagactcatctgcatataaccttaattcacctgcatgggaccaaatcacttaccgggtgtgaaaatcatgacttaaccatccttctattacaagcttagcactcagtctaataagtatttggtgaatggataaaatcgatcctttattttttatttttattcttttttgagacaaggtctcactctgtcgcccaggctggagtgcagtggcgcaatcatggctcactgcagccttgatctactaggctcaagcaatcctctcacctcagcctcctgagtaactgggactaaaggtgcgtatcaccggccaggctaatttttaaaatttagtttaatagaaacagggcctcatcatgtttcctaggctggtctcaaactgctaggctcaagcgaccctcccacctcggcctctcgaagtgctgggatcaggaatgagcctccatgcccggccacaaccaccttcaacggaaggatattccaatatctaactcaaactctatttcctcttttcttgtattctgcataaatatctaaaaacaggatcccatcttcaggactcctgtggactttgatgaggtcccttcttagctaaattgtgaactctatcactgtttggaagttttaacattcaacatgtgactcccaggactcatgggctccctgctcttggagaaaatatcaggcaagcaaaattaattgtggtatgttacccactagctttgtcttccattggcaaacagattttattcttgaattagtagaagaactgatttgacttctcattctgcatcaatatgacaatgaaatcaatatctttcatgaaaatactactagttggaaaatatagcacaagcaagcagctaaaactcagcttagaaactgagttttccctcagtgatgatggattctgttctcttccaggaagagatgaaattctattcaaaggatgtagcccatgatgcatcccatacgtttgctactcagcaggttctgggacatagtcacagagttaccatatacagctcttatgaccaggctggtatgtgataactcagaatcagcttcccttcacagtttctatgctaatctgaacaagtttgtccatccagctggactttcagaagtcacaggtctatggaagggaaccatggcattgcatggaattagatttaaccctaattgctttacttttttattttttagaaacagagtgtcattctgtcacccaggctggagtgcaattcatagttcactgtaacctcaaaatcctcagctcaagcaatcctcccacctctgtttcccaagtagctggaactacaggcaggcaccaccatgtctggctttttttttttttttttggtagagatggggtctcgctatgttgctcaaactcctggccccaagtgatcctcctgccttggcctcccaaagcactgggattaccttacattttacctttaaaaaatgccacaaaaactatga

SEQ ID NO: 1484 - DNA, 2350 bp, artificial
  synthetic oligo
aatctgaatatactgaagaccactgacttgtatacttaaacgtgtgaattgtatgatatgtgaattacatcttaaggctataaaaaaactggcttaacaatgaaaaacccatgttttctttcaagatgtaatgaaaagtgaaattacacatatcaccactactcattattttatttttaggttaaagattgcaaataccttaaaatttgagtctgaagggacttttatttctacaaacctcatctattttaccagtaaattaactgatcctggttaaggaactaattgtattaagaaccaaagtcccgacttaatgggccaatggtcagaattttcccaacgttaaatcatttcaattaaaacattcataagaggatgcacggtaattaaatacatctggaaaaataaaaccagttcatggccctgtggtgtatttactaagagtctaccaaaggaaatcagtatgtttccttttttacatgaagggaactttctttttaatgtaaaaactaaaaccaaaaccaaggatactgccagaaccagtgaagtatgcacaaattaacataaattggcaattgaaatgtggagccaacaattgtccaaaacacaaagtacttccttaagaacaggtctctggctcgggcctttgcttcatgagaactgcacccaactccacacctgtttaaaaatgaagcccaccctacccctaaatcagtccaaagtattgtgaaagctgttctggagaaggtccccgtgtgataattccacgtacaaatccaaacgcctagcgttaaattaaaataacgatttcagaaaaagtagttgatgctttcctcaataccacacttgttcgtaactgtaacatctttggtggcaattatcaccaaagtgatcacaggctgagtagcagtcatcctctgagcctcattttgtgtatgagcctcatttaaaacggaggttgaatggtttgactgctcacatgggggacattaagagaagtaggaacctgagttacaggccactcgattctgccctttctagaaggatcttatgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtg

SEQ ID NO: 1485 - DNA, 1350 bp, artificial
  synthetic oligo
ttctcagtcttatttgctactacctaaagtgattttgtcatgactaggtttatttctttattgtcagtttcatctagtagattggatgatccacatggcaggaaccttgtttgctttgatgactactgtatcctccgcgtgcagaatgtatcagatgctcaagtctttgttaaatgaatgaatgagtacctcctccatttggatttattaatttatgattcttctacctagtgtattagctatccccgtctactcttggcaaacactcctaaattttcatccaccttgtggataaaaatatagatcttaacaatctttcttccttcagggtgacctcaattcattgatcagcattctttgagcacaattgttttcagccagcttggtaatccttgattgtgctgacactcggcacacatttctgtatattgtccacaaggaaataacaacttctgttgtggaaaaaggccaccgtctgtttagcacacacgaagtcctaggtttattcagctgttcagctgggacaggcacctgttaacagggtgatttccaaaatgcactgtgagcaagtcccacttaaaccccagaaagaagaacagatgtaacaattatgcaacccgctgcatatttcaatgcccagaaactgcctcatggagtaggaaccagctcttgtaccatattctaagcaaggtcaaggaacacctgcagtgcaacagtttctgctgctctaatgaggtcattaaatgtggtttcaggactcttctctcttgtgaatgaccattcgtctgctttagcactttctaaagtccagactttaggagggcgaacatgtctctattctcccatctagaaactttatccaggaaagcaatgaagttgagggtgaggagccaactgctgtgatttgatattttctggttccctataatcatctctttcttttaaaatgtgcacagagaccttagttgtatggtaaatctaccatacatttgtagatgtaccctatacatcaccatatatttccccaatgtattcgtgaaatagaggttggcaggaaaagtattatcaaaactttgcagaagagaaaattaagattcagtgtgagagtgccttagctatgtttctaagtctccagtcacaaggactccttgtgaatttcccttcccgcctaccaatatcagcatccacttagaagtgtgatgcactaactaggtgacctgctgttttcttttggacaaattacctaacccctttgagcctgtttcctcatctttgagaggcagataagaataccattggcccagccgggcacagtggctcatgcctgcactcccagcactttgggaggct

SEQ ID NO: 1486 - DNA, 3250 bp, artificial
  synthetic oligo
cctaggagtagaattgctgggtggcatgataattttgtgtttgactttttgagaaactgccaaagtcttttccaaagcagctgtataattttacattcacaccagcagtgtatgagggttccatcgtttccacattctcaccaacactcgttcttgtctatctttcttgttatagccatcctagtgggtgtgaagtggtatctgattgtgagtttgatttgcatttccctgatagctaatgttattgaacagctttcattgtttattggtcattcgtatatcttctttgaagaaacgtctattccactcctttgcccattattttagttatttgtgttattattattgagttgcaagagttctttatatattctggatctagatttggtctttttctaagccatagttttcggatatgtgtgcgtgcatgtgtgtgtgtttgtgtgtgtgaaatccagacattaggcatcttttagaaatgggcccctagagcagaaatcggaccattttttttttgcctgagtctgaggggatgattcttacagtgagtgaaactgaaccacctgtaaaaaggagagtttattttctctctttggtgccccctagcctccctacctaaacacagatctccagagatggaggaatggaaaaaagaagtaataaatcattcacactttagtaggatcatcatgcaaataacaatgtaaaactccaaatgagaggatgagtccatcaattgagcctggtgaaatccactgcagaacgaggtcttaatggaaaaacataaataataaaaattttcaggaaattagacccacattagtaggaaatagaaatgtttaatgtgttggacaaatggttctgtctgaagaaaagtgctgattctttcattaataacagatatatgcaggttgatttaaaacaataactgaatacctgaagaaaagtagggaagctgtgccccaaaggcccccgccacatgatggagcagcggcaggagaaagaatggatggatctagaaggtccttccggttctttcttgcctgcaaacaactctcaagttcaatccagctccacctctcccctgcattctcagacctcctcagtccacccaggtccccttgttctcctaccgctccacaacgtcctgtctctaccacataaccttggattgaattctctgtctcctgaaattgttttctctgtgaacatcttttctccccaatctccttgcaagttctggaggcctgagactgccattcctcaaatatgaagaggggatctctcattatttgttgaagcaagttatactatgacccattatattatgaccataagagtgggaaatgctgccagcatctcgcgctgttgtgctttgtcgcagttctcagggctactggcagaagaggggaacagcaggcccgggggatgcagcttctgtcccacgctacttggctctttctctttgcctcttccctttttggcgcctctgctttctatttctgcctttttcttttcttctttttaagcccttctatccttcccactaacataataggaaaaactggtattcacagaactaaaagcttagcaagagcaaaaaaatacccgaattatttatttggttctttttaattttttttctttttctcttcttgtgtctttcattttttaaaattgggctgagtgaggttttaggaatttgtatctacttagtactgtagatgttggaagggacctgaaatagaccatgcagcccaacacataactttataaagaagaaacagagatttagagaaatttaaggaaaaaaaaaaaaaaaagaaagaaagaaaaggaggttcaggaaagtgcctgcccaaaatagcacaaccgaggagtggcaggatcaaggttacagcctgggtctcatggctccctgtccagcaggctcacccctgcccaaggcacgggatttttaggcatatgaatgcctagttcataaggaaggaatgcttgagaaatgccactattatcacaattagcaatatctgcaaacgagtttcaggtaggccgatttaatagcctataaatctaggaattaaattcaacatcagacagaaaggaaagaatacattgctttgtctgacagtttttctaaactcatcatggcagagtttcctaaaactccacagcctcctaccctgtaaaaatgcttgcttatttctggcagccaattaaaaccaaaatctgatgctataacagaaatcggaagctggaaaactggtgcaatatccgattcagaaatgagcgtgaatgtcaagaggcctctgctggcattcttgcggcccagcccgggcactcgtggcttggagtcaggctgtctggtgtaattaaaagtcatgctatctgttgggggaatggcctgttccaggatttgaaaaaaaaaaaatgctgtaggaaaaagctccatgaaatgtatctattccatggaatttcatgaaatatatctgcatgataattggctgacattatggagggcaagaggcaaacatcgggccctgagaaatcctcattaacttgctttgagaaccttccaatgaaaatagaaatagggcttccttccagcagaagccttaggactagcttcctctgttttcataggcagcggaaacagcaatcttttgtaatcgtttcttttagaaaacaaaaacaaaaacaaaaaaaaccttggttctgcgacgtaataacaaaaaaagaaatagtgggacaaaaaaagaaccaacacactgagataaaagacatggcacaattgctatttgatgttttctgaaaagtatcatgatctgcatggatttttacttcttcaatcctcatgatagttgagactgtgactatagcaatcaaatttgagtggagcatcagttgaatcagctcccaggataatgcaattttttgggagaattgtgaagctcagggttttagaagtaatattcatctgaatcatgctaagatgctggttgtcagggagatgatccatgtaggaccgtgggacaggacccagctaggtggctgccagcgagcctgcaggccagtcttttgagacctcttggttcatcaatacattccaggagagcaccatccctccccagagagacatggcaccaggaaggtacccatgttatttcactcctgccccttgtacccttgtggttcataccttacacctttaaaaagccaatggaagaaacctcagggcctgtgtgtctct

SEQ ID NO: 1487 - DNA, 1400 bp, artificial
  synthetic oligo
gggatttagggagccagaatggcccttctgagttgtagaaagttgggctgatatggtgggcacttttttctccagcatggatcagtcattggatgtgggctcctgaaaaggggtgtgacattgcgtaaggaggctctctgtgactggagccgcaagttcctcattgaaggggaatctggaacatcccagtgttcatggcatgtgctactctgcagttgttcatttacttctcaccattttccatttaataataaaattcttgagaattgagaccacatattattttgttgtgtatcattgaaatccagtatgctacatgggaataaatatttttaaataatgaaacgaaatgagacaataattgggtggatatttgtaaacttaaatatgataataaatggtttcattatgcattttattgagatatgagaaactttcaagagatttatccatatttatatttagttatgagttcttttttgagaagtaacaatttactcagctgacagcactaaacagtactgagctaatctttaacaatgttttgatttctgtaaatgagattatcagtaatttaaaaagaggattaggaagtttgtgtgggatagaaccaactaattgctgaaatatacacagaattcaagtattgaaaagttttactttaaaaagatgtgattataaagcattgtttcctatgtatagccctgtaaaataatacccatgtgcatccggcagagggcacaattgtacaaagtattggagaaatgcttttaaaaggaagtgcattaatctctcagtcataggctgtagtgacacatgtcagtcacatgtaaatgactctatacatctaaaattcaatagtgtattgtttttagatgatatttcactactgcgtttccagctctattctttcacattgtttttaaagttactacatcttcaacaaaatccgaattaggttaaaattaatctctaaataattttcatttcaactggctaaaataatttgaggccaacaatgtgtaaggcttttttagagcataattttacgtatgttatgttttctgtcctcacaagatattttatgggtcattgacatagaagcacaactacatatactgtgcagaatcacccttctacattaagaaaaaaaatcaggtcctgtccctgtatactgtcagatttttcttggcatggatcttgtacatgatgagcttgcacggtgaaatggatgaatccctgtccgagggatggaaggtctgtctttgtcccttcctggttgtgtcactacttctcagagcctgcctatcttcatctgttagtagaggaacaatgatgcccacggggccctcttcacacatgggtgttgtgagttcatggtttaagagccatgatatcca

SEQ ID NO: 1488 - DNA, 1450 bp, artificial
  synthetic oligo
ttaaatttctttacctaatggattaaattggccttttgattgtcttgcccttgaatcctatttctatgggattatatgttctaagtttgctaaaatatagacttattaaatgaacataactaaaacttttgtaagtagtcatcatttaggtaaaatatacctatgactcaatttaaaaagcattttgttcagcattttcaccttcatgtgggaacagctgctaacttttggtgttgaaaagggaaaagtcaggctttgacttcaaaggagaaaaatgacattgtcgatgatgacaggagtgaagggtgttaagacataattccataattcaagcaaactcttgcgaatcaaagacattctttgatgatccaattgcctccttaagagaggcctttccccaccttctgttctctctaggatagctagtattatccatctgaataaaacgtggctttttaagagaatgacagagtgcactgtgcctttgcattcagtgtattgtttttgatggtgtttctttcacttactccattagagcaaaataaatgattctgctccttggtgtcacatatggtcatgtctaagtgaggactttatgcttatcttaatattttggcttaaaggcagcaaatgaagtcttcagcttctttaaatcctagctagggagcactctgactgtctgaataacactgaaagaagaaccttaatgactggcaattccttatctgaagcgccttgctaacccaagatgagtcacaccactccctcaatgcaaacattcagctctgtaaattacgactgctctcttacgtttgcgctattcattccaagcgaatcatcgattgctgtgctgcacacggaggaagacacgggctgcctcatgggatgaaacgttcagcgccatgcctggtacacgacagcgctgaataaatgatacgattatctaaaagcagcgaaagaaaagtctgtctgaagtcaggttccccggcagcagacgctgacaggagaatctaagagcccgtgagtttctcaggaagtgagggcaggagaacaggccagggaagtccctgcctcagcctgatccttggggagctctggaggatcaatgaaggctcagagcctctaggccagggagctaggcctccatattcctacggtcactgctggctgcagttggcttttggaggaagtgagctcccaggcatttctgctccctggacgagaggatgaagtggctacagaagtcgagggacagtgctgggacccggcaatggaagcacgggtcctagaaagggaatctgaaaggggcaggccgtgtgacgacagtatctacttctaggtcaaggaagggccgacttcaggggcctgcagccaccgcagcagcacagggccctgcctttcgaagaaccccgcacttgggattcaagcctctgcagttgccatcttgaag

SEQ ID NO: 1489 - DNA, 1200 bp, artificial
  synthetic oligo
aaaagcacttaagaaagattctcacaatgagttaatttgctaggacaaagggtacttccagtaattgtgttcttttataaatgaagctctagtgaaagcaattagcttttttaactttcccttttctttcagaataatccatttgcttcagttaatttgagttagttttcttagacataaatatgctccgtggatgtaagtaaataagaaggttaaaactatttaaaaaaaaaaaaaaaaggaaacaattcttacagaaacctgcatcatgatatccaacatttatactgtccaatttactttggattaaattctagtgccttgaattctattataccagaaagtcctctgcacattttcaggttgttctggagctatgtatacatgtatatgtgtttaaaaatctcactgatttcttggttcattttggaaatcatgtacatatgtgtgtattcttaataagtttctgaatgcaagaaatttccaaaactcctaatattatgcctgaccctttcattgctgaatctgagactataacaaaccaagaagccaatcatttctgtttctcaatccagtacctatttatcttttttgcatcaagttttcactctaatactatcatacagattcgttcagtagaacttatgaaatttgccctgaactgtcttcgcccactaccgtgcaaatatggttgaacaacttgaatcaaataccaaataactgttttcagtcataaactaaatgtcaaaaatgtgttttgggtacttttccaatattctagattctgtgactccagctacttccttttagtgggggtgcagaggaaggaagctattattagaagcaataacaatagtataacacagtccagaagaatttaattttttaaaatgtggctgaactggtaagttactaaaaaggataagtgaaaggaaattgacgtaaaaagcaaagcttccttgcaaatcctgtatttactgctctgggatttcttaaaactgcttaagaacttagtcattaaaggtggaagtgcatcttacacaggagctatattctaaagtcagtgcttaggatagaattgagtatagttagaactgttctttaaaaatcattaggaagatgtcagctgggttcggtggctcatgcctgtaatgccagcactttgggaggccgaggtgggtggatcacctgaggtaggga

SEQ ID NO: 1490 - DNA, 1700 bp, artificial
  synthetic oligo
aagtactgggattacaggcgtaaaccaccgtgccccgcctatatatacaggcctgaacccgggaggcggaggttgcagtgagtcgagatcgcgccactgcactccagcctgggccacagagcaagactccgtctcaaaaagaaaaaaaaattaataaataataaatacagcaattcagcagggctgctgcaacaccagctttcccagctctgggtgctggggcttgtctccgtcacaagcccccaaggatctcaacagggtgaacaacagttgcagaaagtgagctgttgccttcaccctcaccctgctgctccctttgctctccgaaagttacgaactttgagtttccttcccgataaactccaaggtttcctcactgattggtctcagtttgggaaaggacgtgacatcagcaagtttgcagacttggggctggagagttaaccagtatattactaaccaatatactattatttataagaacctgtgtgcaaatgcctaaacccatttttcagaatcctttcagccaacaggcacctgctgaatgctcaccgaagtgtgtatttgtgggattctgtacattagcacagacaccacttgacagatgagaacaatacctgtaagatgattctccaatgttttaagtaaaacaaagtctcttttgtctcttttgaaagtgactcaatcagtgctcaatgtttgaacatctttataaaccctgccccacctaaatgccaaacacctaagacttacaaattaaaaagttttagcattaaaaattttcctatttataagtaactttcaaacctccaatttaataaataatgcatttgacccacaaagaatgattcctgggagctgaaattttcactggagaataatttgtgacaattgaatttgtcttgtctgtaggattctgcagaaagaagtatacacatttttgaacagctgtgtaaagaatatataccagtgagctgtggacatctgcccagtaacagccccatggacacctcacacagagccactgaaactgcccaaccctcctctcctaagcacattagccaacctccccagggctgattccactgcccctatgactcaccgcccatcaatgggtttgaaagaagcctgatgccaggaaagtcccttggccccgcgggcttgctcccatccatgcccccttgtttgccatccatgatgctctctcctaagcgagcaagctctgcgctccacttcagttgctcagcaaagtccaaactccatgctccccctgctcctgaaaaattccagttctgtggctggctgagctgcacacgttctggtcaaatggtctgcagcaaagcacagagcaggcagggtaatctgagtgctacctgtgatcagagagaggcatgcgctcgtgtacacacacacacacacacacacacacacacgttttacctaactggctggaggcccgccagaggccacaagaaccctccagccctaagtctgcgaagttgctgatgtcacgtcctttcccaaactgagaccaatcagtgaggaagccttggagtttatcaggaaggaaactcagtttgtaacttttgagagtgaagggagcagggtgggggtgaaggaaacagctcactttctgcaactgttgttcaccctgctgagatccgtttgttacatggtagcttgttatggagacaagcccg

SEQ ID NO: 1491 - DNA, 1000 bp, artificial
  synthetic oligo
aaaaatcaaaattataccagatttattcaaggaaagaaagaaaaaaagtggggaagggctgaaggaaggaactaaatcaagaacatatcttggaatacctaacatttgttataatcttatccacctgaatttatatgtgtctatacaatattcagaatgttgacttttaggtacaagaagatcccgaatcatcaaaaaacagcctattgttttcactctacttcacagttcttttaagtttcttaacaacaagagctaaaagctaaatggtttctacttgccccttggttaatgagaacattaaactaaccaggagtttccactcctcaagtgttctagctcatgggggatttacttcgactgagctcatttaaagatactaggagtctaagctgttgagcttctacattaggtactctaggtacagcagacaacaatctgtgtcattccaagtatcttcccaggaacacttaggactattggtataggaggaatcgttcgagtggctctggcagatgtagcttgtggatggcttgatgacatgctcgaccgagacacttccggacacacaggcggcagagctgggaaagagcaggtgggcctgagagagaaataaaaatggtgttaacttcatagtggtgggaggtggggtggaagggggaaatcagagaactggaagaggcggaaattttctaaaagcagaagagaagctggatctgtataggaactatagaatgaggtagcggacactaaatacagacagcagatcctgatttgcccctctggaagggatgcatttctttaagttaatcttccaatggtacttggattaccaatgttgaagaatgaagctaaccagaggcaagttaggaatgaggtgtggggtctaaagggaatgcatctcattcatgtattgaatgtgccaatgaaagtgatacacggggccaggcacggtggctcacgcctgtaatcccagcactttgggaggccaaggtgggcg

SEQ ID NO: 1492 - DNA, 1050 bp, artificial
  synthetic oligo
ctattatactgcagaatgtcatttttcagacaatttaatctcccaaaagtttttccctaaaagctttgttgtgggcagcttagtgtgatgactgagcatgggccagtggagccagactgctagggttcaagtcctaccttgatcactttctctgccaaattcagcaagttaccaaaattacttgaaccccagtttccttactggtaagatggaaatataataatctgatatttgtcaagtgcattggtctctaagtaggccaatcaaatacaaccgcgatgttaagtgctccggacattgtatgattaataagtaggcacagtagagcagtgccataaggaacagccttagagccgccttccagacatatttttcttataattgcttatctgcaaacaagactaactagtttaaatgagcatttgagaagtaaccccccattaaacctgccaaagggcaatcaattgttttggaagaaaacctactccagtttgcaaaatgtaggactttttcacattatggttgtgcttttcatgcactgaatagaatgtaatataatttggatttaacacaaaggctcctcaacctcttgtgggtgatcctgatggtgttaaaaactcaggtttccatacctataaacttggtgaaacgaaaatcccagcaaaaatggaattgtgtgaatttgaaataactgaaggccttaaggaaagaaagaatttttccagtggatgagaatcagggttagaaacatttcaataagccctcctcctacactgaaactcaatgtatgaacttctctcaccctttgggttctgaaaatgggggaaacttgaatgcactttacgaggttggattgatattggagcaattagcatgaaaatgtgattttcaatatatctagatataaaagtaaatttaaatgtaaaacatagatgtgcgtatatacgtatttttttttagcatggtgcactgagaaaacctgaacccggactccttagagaaatgttgatcccaggtctgggccaggtaaaatacaagatgggccttaaa

SEQ ID NO: 1493 - DNA, 4700 bp, artificial
  synthetic oligo
agactagagtagcaatcgatactttgccctgtgttaatattgatgaagcatcggagaattacagtgatgaagactcaaggacacttaattaagctttataatttgtagttggtttcacagataacagcgacattaccagataggtacagcatttggcctcctttccatttttgtaataggttttaagacaaagagtgggggtagaaatcctggaaggtataaatgagggttaagcctcacttattgagcccctggtttgcccctgccatagttctgatcacagtacacgtttgaaattccaccatgaatcttttttcaaaatataacaaatatttcttatttttatcatcaaacatttactggatgtctgctctgtaaaaggccttgtggggaatacaagaaatattaagcatagtccctgtgtttcaacagctttttattttttctagcttttcctgtacatgttatcaatagtcaaaagaaatccacctttcttaaaaggttctttgtgtttcaaatatagaataggctgacctttataaatagatattaatagaggcacactgttgctgagtctctgtgggggagggcgttgaggagcctgcaggctgttccaacaaagtctgaaaacattgaacatttatttaaagctccagcttctgtcctaggcactgagcattaaaagataaataaatcatgattccgactcccaagggttcataatctcacctgggtacatgacttcatttatagtcagttaagtaaaggtctccatttaaggctatattctaaaaagtcaaaagaaatttgtagtagcaagattaagatataaatctggagatgattctaattatggtgtcctgccttaatgtatggtctcaaggtatgtcttgagagaattttctccggaaccactaaaattagactaagatacttacatgcattatattctgattgcacttaataaaatatgagggcaattggtaccagttttagtattaaacgacctgagatgatgaagatgtaaaataaatgtagatatcatcttcccttgaaattcagtttttgcaacttcatatgtaaattagctctttgggataatcttggagtgcgaaggcaacaaacatgtcttgagagcctactatctgtgtacaaagcacgatgcagagaaaacctggcatgagctttacttgcaaggaaacaatacagagttaaggcatatgtaaatatctacgataaaaagcaggaagtgataaatgccataagagaaatataagaaaaatattgggagttcaaaggggaagagtatttctagctgccagcatttagctagaagaataagtagatggtgtcatgcaactcttgggaacagggtaattccaagaacaacatgaatgaggtacagacaggtgctgtccagcaaacactgctttgtaatcacaaaggaaaagagaagggaaagtgggcagacagaagaagagtggcattatcaatgaaggttagagcaaactggtagaagatattactaaggaaaatgggcttgatgttgaggcggacttccagccaagatcacattttcaattagtattttgagactcctaactcctgattctgcttcaaatataacaataagtgatacaatataaatgagaaaatttaatgttttacctgtgatttaaacaagaagataaacatttccgtgtatcagaaacagaaccaatacgcaaaatggtgatcaggaacaaagccacctaggtcctggattctgtatgtggcagcaggaagatgtgaaccagggttcagcccctgtagaataatagactaacagggttccatgtgtggcttgatacaggaaccagttttgtgagagactgttacaacggtgaccttcaataaaccagtattccatattggcagccttgtctaatcctctcccacattggctctgggtttgagcatgtgactggaatggccaaatgagatgccacagatgcttaataagtgtttatttactgggatgcatcttgttggaacctttcctcttgaaagccaatgaccatgctgtgaagctcagacaagatattggataatggcaagccacatggagagaagccctgaagaatgagaggtcatcttgggcattccagcagtaagtgagttcccaatttaatataaccactggagtgacttcagcctatactatgtggaaagaaccacttagctgatcctaactaacccacagaattatgagaaataataaatcgttattgtctcaaaacattaagtttttgggtgatttgttacatagcaatagataaccaagccttattgcttaaccatctcccctacttgtgaatagacattgaaagaattttttgccaacagtctgaggatataactttgctaacagaactgagccaagcaacataatttgcaattttccactatcactgctagtctgggggatataagcacacacacacacacacacacacacacacacacatacacacacacacacacggggagaggagagagtgagagtgagagcgagagagagagagctctcaagattggtttataaaccaaaattcaaaaacaatggaagatatataatattaagaaagacaacacacaaatgtaacaatggaagaagaattcactctagacgcaattcaaataatttttgaaatgacatttttaaaagaataagaatttggaaataaaaacatgcagaaattaaacaaacaccagtggatataaaagaatcaattagataccttgaacatgaagatgttactagcatttttaaaactcatattgataagctttaggctacacactgttgaaacaaaggttagtgtggtggaaaagagtaactaaggcagttacttctttttgatgcagaatatgagatgaaatgtcaaaccacaatcaaagctttgtcctaggaaaattgttccaagaactggagaaaaggaaggtgaaagagtggcacagctggagaagagaccagttaggctgttccagtagtccagaagcctccttgcaatttaaagtaggggctgcagatcagcaacagcaactgggagctggtcagaagtgcagactctcagattctccagacctgctaaatctgaatctgcaatttaacaagatctggaatgatagtatgcacattatagcttaagaaactagctctagactagaggcaatgaggacctgatgttttctcgtggcaataaaaaaaaagagagagacaaggaaaatcacaggatattgggatttgtttgagtgatgtcttccttttcgttttagcacccttttttgaagaccgtcctccagtagcctcctaaagaagactgcatgggagatcgggagattttctaagaactttaatgtctgaaaatttatttttcagccctccaattttattgatagtttgggtgccaaatagtaggccagaaattattttccttcagaagtttagcagcattgctctagcctgctagcttttggtgttgctattgagaaaactaatttcattcggattcctggccctttgtttgaagttatcataatttttctttactctggaaacttatacattatctcttagtctcccgtgtcctgaaatttcatcattttgtgccttggtataggcatagtttcaccttttggactagggactcagagagccttttcacttgccaactcatgtgcttcgaaattctcttgaatttttaaattgttgattacatctcctattgtgtctcttctcatttcctgtaacttcagttattctgatgttagaccttcttatcttttcacttttaatttcttatttattctacttcataggaaatttcttcaactctgtcttccttttttgttctattgaattttcaatttattataatagttttagtttcctagggctcaattatgtcctctgacattttcttttttaataacaccttcattttatttattagttgcactgtctcaccttcttccctcatcccctggctattaatgatttgaagttttcttctgtttcctccaaattgcctttttctgtgtgttttactctctgtctttcatgttagaaattttccctggaggtctgggaattcatgcttgcttgctcatacttaaaagaaagggacaaaggagctgatctgaggtctgagcccaggaatggggcttgatgacctctttgggctgttccatttgatagtccctcccccagctaatttcagtcctttttaggtcttttctcttaggctggtaagattccccctagagaaatacttttccagtacagatccaactgcctgaattgtggttgcacctagtatgtacgcgttcacttaatcctcttgttagttcagcaccctgccctcatggatgtcaggcatcccccattcaggatgctctctcttttaccttagccaaacgactaataacccatcttttgcctggggttggaaggagcagtcactccaccacagggaatgtgggagaagatttgggatcaaactgtttcttatacagatttttggaatgaacctcattttagcacccctctcatccctcccatttctagaggtgcttgggacacccacttctgagccttttgggaactcatctttccagactgttggcttaaattattttttttttcaggtcggccacat

SEQ ID NO: 1494 - DNA, 5650 bp, artificial
  synthetic oligo
caccaagtttgtgataattagttatggcagccataggaaacgaaaagatgtttatcatattatttttgtgacagtagctactgacagttgttttcatctctgttatttgtttgagaaattgatccacaaaggcctgggtaacctgactacagtcacaaaaaaaagatatcaagcccctgataacctgaattttcttacttctaactctctttgttttcttttaaaacctactatttcaaaaacatgatttttttctgacaaaatacttttctggggttttacgctctagaagtataagagtttaatattcttatggagctatcaaatactcttctagagtttgctttccatacagttgcatgaactgtattggcggatacagtgcaactgtattggatgggtttgtaagaaaaaaaagacttggtagataaaagattttcagtatgtagcctcttgttcaaaattgggggcttagttatataaataatgatatatgcatacaatgaattctatgtgatcatcaaaacaaaggatgtagaggtatattgggacagaacgaattgagatccttcctggaatgtgctggagaaatgataaggtgatctatctatggctagggcctccgattttctcttgctgacccggtagttactagatgtttgttttgctgggtggttggaatatgcaggctgaggccatttgtagagctgggatgagggaggaggcaaaggaccagtgctgagagaggagggtggaagggaaaggtgaatgtcagctgcctgctgcagggcgaggaacagtgaaggaaaacaaagatgagcaaaaggggctgttaaaaggctttgcattgggtagtgtgatgtacactctcctccactgagcctcaaaagctgtagttaaaatctacatcatgcattagcattttaggaggagaaattttttttagacatgctagtggacactgagagttgtccaaaaatgggtactcagaagagcaagtgtggtctaagtcatgtgtgattcagctatgatataacctcttttaaaattacttatgtatttttacttatgcacttatgtacatcatatatacatacttatatggatatatgaggaacatctggagacatatacatgaaaatgtaaacaaaggttattctttatttattttcgagaccgagtctggctctgtcatccaggctggagtgcagtggcaccatctccgctcactgcaacctcagcctcccaggttcaagcgattctcctgcctcagcctcctaagtagctgggactacaggagcctgccaccatgcccggctaatttttgtacttttagtagagatggggtttcgccatgttgcgcaggctggtcttgaactcctgggctcaagtgatctgctcgccttggccgcccaaagtgttgtgattacagacatgagccgctgcgcctggccaacaatggttattctttagatcaagagctgtcaaactatgacctcccagcctaatttagcctgctgcctgcctgtttttgtaaatcaagttgtattgacacacagccatgtccattcatttacttattgtctacggctgctttcatactacaaaagcagagttgagaatttgagacagagaccttcatggcagtttcaatctgaggccacttgtcttttttattctcaattctttaatattctcagccattatcattttcattattccacctataatattgcctctactctcttttttgaaaaatgttggaggcttttaatcatcttacatgtctcttaaatgtgcttttatatttagctattttttcctcttcacctctctctaatgtgttatgggtaaattaattggttcatctttccaatcaccaactctccaattgttgtgagtctagagtttactttgttaaggttttaatttcaatcaccgtatttctaatttcaagcatttctacttcattcttcttcctatctactttctgttacatttctgtatattcttcctagtttgtttgtttgtttgtttgtttgttttgagacccagtctcattctgttgcccaggctagagtgcagtggcgcgatctcggctcactgcaagctccacctcccgggttcacgccattctccctcctcagcctcctgagtagctgggactacaggcgcccaccaccacgcccggctaattttgtttttgtatttttattagagacagggtttcaccgtgttagccaggatggtctcgatctcctgactttgtgatccacccacctcggcctcccacagtgctgggattacaggcgtgagccactgcgccctgcccctagtttgtcatttcaattttatgaatattatttctttatctctttgagggttgcaaatatttttaagtatttcttcaaattattttagattttaactttataggtatgacatatactgattattcattttgttgctgtcattcttagtaataattatattaacgtgatttggaattttggttagtagttccattttcattcagagattcatttttctttctcattattctttctccaacatttagaagttttatggttgtaccccataataccctgggtcctgaatccgaatcttgttgagtatttatgattcagggatcagctcagctcacgtcctagttgcaaggaagtatctgcttcctcctttgccccgttaagtaatttcatagaagtcacagctccaggcagcaatgagcagtaactcttccttcctctttcatggatctgatgtagtgcactaaaagagccgatttccaactgaagctaaatttttgatggcccctgtcttctagcccagatccataagtcctgcagcttcagcttcatggctttagtgccatttctgtaaatgattgtcatctgcagatgtttgccatcattcaatcaattttatattctgtggactaagaacgatctgaaaatatgaatctacaaggttatcgcacttgggaatccagatgtgagtgtgtgtctgtgggtgcatgtttttaataaaagcgggagaattataagctgggggaaagaggcaacagacaggaagaaagaaaaagcatatgcaggagagctaaggcaggacctagaggggttgttttgacataagtgccagagataagtggatgtagtgtgactagatgagaggatcactgtcagaaacaagaggaaaatacagaatgacatgggtttgtagatggcaagactgcctgggaagctcagtgagctcatacctgtgatttctcacttttcgataaagtttgaatcaaggcaaaattgtgggagtgagaggagtggggagcatgaggatcatagatcgggtttgtgaaattggcttgccacagcttcttcatctaagaaatctggagatgaaactgaacaattgctaatgtctctggcagctttgaaattcaatgcttctccattaagtcttatttgtcaatagtctctcttttcctgattattcattctcttctagttggacagtactccatatacaattcagtcttcaaaataaaactttgtgacaatgctgcttccacgtgaaaataatgaaaccaagcagctttttaaagattttagagttgaagcatattgaaaggatttttatgtattgaggcaaatttcactcaatattatccaaaaatacaaggccaggcatggtggcttacacttgtaatcccagcactttgggaagccgaggtgggaggattgcctgagcccaagagttcaagatcagactggaaacatggtgagaccctgtctctactaaaaatacaaaaattagccagacatgctggtgcatgcctgtactcccagctactcaggagactgaggtgggagaatcacctgagcctggggaggtcaaggttgcagtgagccatgatctcgccacttgcactccagcctgggcaatggagcacgatcttgaaaaagaaagaaagaaagaaagaaagaaaaagaaaaagaaagaaagaaagaaagaaagaaagaaagaaagaaagaaaggaaagaagaaagaaagaaagaagaaagaaaggaaagaaagaaagaaagaaagaaaagaaagaaagaaagaaaagaaggaaagaaagaaaggagagaaagagaaagaaagaaaggagagaaagagaaagaaagaaagaaaagaaaggagagaaagagaaagaaagaaaacaggcagatgtatggttttattatagttcttacaggattcaattcaatcttagaaatatttttaaactatccaactgtgagaactcaggagaaaatatcaaatctctggattgaattaaagtaattaaatggctcatacaacttgcctcatcataaaaaatgcagtgtttactcaagtactcagagttatttaagcttactttcaaccccagaatttaaaacctagtttgaaataacagaaattgcagacagtcattttgctattttaagtggaagtactaacaattaaacttaagtagaaacctgacaagtaattcatcaagggcatacattttcaaagggttcaagaatggttgtttgttcccaatcggctttctgcactggttgatttttgtataatgaactttatgttatccacttgggtaagacaaaaataacaattaaaaatgtgtttatcccaaatacatacttaaaccattgatttcagtggttttaattactaaacctttgccaagtaaattgctcctaatttcttcctattttctgatggaagtgctaatcaaaatcaaaataattaaaaggttttcatcaagaggaagaaagtgaatgaagcagggttaccagatctctgctttttattacagcggcagcttttttatggtaattaattcaagactactagcaatttcactcttaaataacaaatcattctctaatttcttggctaccacaagccagcttctaaattgggaggcttaaagtctttttaataagacttcaccatcatttgaatgtatgctcctttctgtggtacaatttcaagggtagtcatttccccttttgctaatttctaagttcacacagcattctcccctgaggaagcatgagcatctccatagcttcctaagtattaatttaggtcacgggtgaccaagatggcaggcaagatatttggaaaggtatagtggtggggtttgtaggagaaacttggaagtgtcccacgttgtgaggaagtcaacggccttctgtactcctaccaatttcatctctcaatttccagcccctctccttcaccaaaaatacatatccagtcaagtaacacattcaaagaatgaagaaaggcataatttggggatatcaacgagcctcaggggaaaaaaaaaacagcaaggggttcactttggttgggcatagagcaagtttagaagtggggaatctggcaaataagttaggaagaggggctggtgaaatgagataccacttcacacccagtagaatggctataaacaaaaggactgacaataccaagtgttgtaatggatatggagcaacaggaaccctcacacaaggctgatgaaactgtaaaattgtattgttgctttggaaaagagttcagcagttctctaataagctaaatttattatacaacc

SEQ ID NO: 1495 - DNA, 1450 bp, artificial
  synthetic oligo
ataaatatacatgccaagtggaagaggctttggtttgggagtacctagccggttccaatgctggttttgagctgtaaggccatcagcaaagaaggtttaaggggggaccctggctacttttctcaaagagcttcaaaaagcttttcttgagccattccaatcccatgctattaacaatcctcttgttctatatatatggaaaaggaggccagctttgctagattcatccctggacctctagagagccatgggtctgagactatccttccaaggctttaaaaagctgttggtgctattttctttgtcaaattgtgttggcaatatgccttcaggaagcttggtgataaaacggtgtgatgaatagaatttgtatatttagaatacccagaagctttagggtgagttatggaagggacacattttacacaactttccctagatttgcttaaaaatttacaagtgttccctggggggcgtggttctcttcttactcaccctggagttcagggacattgcagtcagcaatttccctttgcagtgggtttggggaggtggattcggttgcaatacaaatagttccatgttccctctacctcttagcagcttcttctgtttcactggaagagcattttgcatttcctgtttaacctgatggttcaagctcaaccaaaaccaccaaatttttcctggttttggggtccaagtagcaatgtctcactccactcccggccttcctcagcagatgttctccctcccccacctgtcgaggtatcttcccagatcaagttagattggtgagtctgagctgaaggtttgtgactttgcctcccatagctctcagttggaaataacattccccaagatgaagctttgcctaatatagtaaaccactctgtcgtctggagaaacagcttactggaaagaaaaagcatagatttgaattgttcaaaactggctttgaatggtataacactctggaaaatgtgtttgcagtttcttataaacatatgctcaccatatgacccaacagtcctacttctggggattttacccttgataaatgaagccttatgttcacataaatacatgtacatgaatgtttgtagtagctttattcacaatagccaaaaaactagaaacaacttatgtgtcattcaatgggtgaacggttcagcaatcgatgtaatactactcagcaataaaaaggaatgaactactgggacactggtagaatctcaaaggcagtatgagtgaaagaagccaatctcaaactgctacatactgtatgattccatttatatgacattcccaaaaaaccaaaatgacagcgaaccaaaaatacaaaacgacagtgaaggagaacagatcagtgattgccagaggttgggaggctgggaggaaggtctgactgtaaaaggataacgtaagtgaatttttggggggtgatgga

SEQ ID NO: 1496 - DNA, 2550 bp, artificial
  synthetic oligo
aaaaaaaaaaaaaatttaaattagccaggcatagtggcacatccctgtagtcccagctactcaggaggctgagacaagaggatcacttgaaccccaggagttcaaggctgcaatgagctattatcatgctactgtactatagcctgggcaacaaagccagactctgcctcttaaaaagaaaacaaaaaaaaactgttggtgtcattattaaatgccacagatgcataagaacattccttgtgaaccaaaaagtggtatgcaaatattaggtggaactagtattattttgcccaatcacttagattcttcagccttgaaattcctattatttgctctctaaacaccatctcctttttttcactctatccttcctttgttgtatagtttcctttattttcatccaatcctgatgtgccctactaattccctgacataaattctcattctattggctatccccacttcctaaatagattctcctgctaggacccttgaaaaagacattttgttgtgaacatattcatgtattaatacttcccagaccttcaccctaagcactcactcttcctcctcctatcaactgaaggactggtttaacccagtgccttcattttccctgtagccctcacagatcacaagacatgaataaaatcttttttcacatgaaatatgatatttataattcttactccctaagtggtgagagtcttaacagtattcttagtggccacagtgaagaagcaatttagttcaaactttcttgttagggcagattcaaccatttccaatcagtataaatcctcagtgcctttgcttcagcaaaagaaatagatgatgttcacaaaaacctttgacatttgattatatactcattatcttaagtgttaacattttacagagagctaatgagttattccagtaggtatttatccttggtaaaaagaataatatgtatttcagtaacttgtaaatcttgtgtggggagagctactttgctttgttctagtttatttcctgagctcattttttgagtatatctttgcccaacatcaatcacatgtggtatttgaagttttgacacataccaaaggcacagtaattgaaagaaatacaagttgcatcctcctaattcttgaaagtctcgaattcgtttcacttttgagtttcttacgatcataaggaggggaggagtacaactgtcgggaagtcgggaaaaattgtaaaatacttgaaatgggcaaaacagagtactggactttttcctgattgtcctgctgagagcacctttctaggcaatttccatctcttacggtctttgagctactttgcaaatccctaagttcttgaaaactaacataatgtaaatgattcttgtccatagaaaatcaaatgaactgtgtctagtggaacataattggttactgcccgaaaaatagactgatgcatccttctgtaaatgcattttgccattcctcactttctatatatgggtggttccttgaagtctccttgaaaaagaatttaacatcttactagtgccctcattaactaatgagataaaatttttgatagtaataatgattagtttgcatgagagtcatgattttacctttttttaaaaaaaattatctttttaaagtaaagactatatattgactgaaaaaggtaagctattgggtccctaacttctgcttactcaatgctggtggtaccaccaccccctccagctgtgacaataaaaatgtctccagacattgcgaaatgtctccagatattgccaaatgtctccttgaaggtaaaattgcccctggatgagaactactgatctatactcatctctaacagaaactaacaaaatgaaatctttgtcattttaataaataattcatgtatgaaacagataaaactcttcaatatctatttttaaaaacagttgaattaatcagcaagttgattgactaatagaaggcatatttaagggtgattaccttatggctgattgcacctcaacagcaggaagggtgtgattttttgaagggtctgtaaccacaaaccagaatgataccctctgggttacattgcaaagtaggacatgggaaattctgcagacagtggaaagaaaaaatacatgagaagaatatcataccaaatggcattaaaccgttcactctgatgctactactatcttaagagacatcttagctatgtttaaaaagtcatttctaccattatgaagaatgagctcagtaagaagaaaattatataggaaattcccattgtttcaaaatcatatacttggggatcattccttatagggaataacagggaatctgccaaaaaataataatagtcagtggagagcattagggatctcattctccatcaccggttggtgacagcccccgtttccccaatgcttggccctctctgaaccacagaaacctttggtattttctcattcaactctttttagtgccctgcccattcagtcttccacctctcagatccagagaggatctgctgccccctcatgattcaatacttgctctg

SEQ ID NO: 1497 - DNA, 1000 bp, artificial
  synthetic oligo
gcagtttttttctacccactttaaacctccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacaggtaagtacaggctgaaagttacatgctctccaagggtgatagacgcctgggtaaatgaactaccatgtcgggacagggagctgattgcacaagggaagttttactcaaacacggattcccttccaggcaggtttttattctgggtatgacttcttgagtgt

SEQ ID NO: 1498 - DNA, 2350 bp, artificial
  synthetic oligo
gggacatgaacttgggagtcggactgcctgaaattgcatccctccctgatgtgtttcccttggacaggttctctaacacctctgaacctcagttccctcatttctaaaatggggatactagcactgtctaccagatagggtcattttgaagagtaaatgagatgatatgtgtaaagtggttgtgtctgaacctggcacataggaaacgctaagaaaatgtcaactgctacacttggaggtgaggaaagtgctactgcagaaatacaaccatttctttggttcttacagaaaaaaggatgattccaaatacttcattatttcatttaaataaaagactatttgtttacttgtgattttaataaagttactaaaatctggagttcacaccctagaatttgccctttacctgagtttcatggggactcgaagcctcctatatgggccttgtccccatccccaggaacacagcaaatcacttctgcacatttgcacgtgctgataacattcccccagtttggaggaaggatgctttgttttgccgcattatcgaagtgtcttgaggttgatgagattttctcttgctgttgttcttgcctttgagttataaattactttttggcttcatcaacctcaatttaagttgggaagggttgtctggctaactctgtagtgggcagtgaaacattttgcagccacagtattgggaggccataatgttccaataaatggatatttaaatgcatatccattgacttccatgattccttaccaccatcctgatgtctctacagatactgaaaggaaattgtcatttgaaaaggctgacttgtttgagatgtgctaatctccccccataaacactgaagagcatatatgcagtgattttctaagtcacatattttgcagacttttaacttgggaatgctgtgctaaataaatcggaaaagcccaggcaggtcaagaaaacaagggcattaggtatctcaaagtgacaaggtcactttgattcttcctgaaacacaaagatcacaaacatccatagtcgcctggtgactgagctgggcttagaagtcaagtgctgtgcaacctcgttggaaatggaggctattattctaagtgaagtaactcaggaatggaaaaccaaacatcatatgttctcactcatatgtgggagctaagctatgaggatgcaaaggcataagaatgacacgttggactttggggacttggggggaaagggtgaggggtggcaagggataaaagactgcacactgggtacagtgtacactgctcaggcgatgggtgcatcaaaatctcagaaatcaccactaaagaacttaatcatgtaaccaaacagtacctgttcccacaaaaacctattgaaattaaaaaattaaaaattaaaagaaaaaaataagagatgaaaggagacactgcacagtgacaaaatattcaaatgccttctgcatttaccccaatctgaaactactaactgaagttctttgaaatccatttatgcctggagctctctcccaaggacagccttccccatttcaaaaacttgaacaaaaattccacaataatatcaaatatccatttggtgttcatatttctctgaatactcaaaattattttcaacaattggcttattttgataggaaccaaaatccacaattgggctgattgtgttatctctacactgcctttaatatattgcttcctttttctctgttttttcttctttcatttattaaggacacagagctgtttgttctacagaaatccctcattctatattttgctgattaaattgccatggtgctgtttagcatgtccttctgtcctgtatttcctgtatttgattaaatttggaagcttgaaaaaaaaagaaaaaagtcaagtgctgtggatctcagtctagggctcctttgcatgacccactttgtggcgtgaacttggagctcagttgatctgcaatgtctcatcaacataaataactgcttggcgggtagaaacctcaaagggcacacaattttgtattaaagagtaagacctggagaattcaaatccaagtctattctactatgtaaattagccaatttcacgatggataataggaagcactacttttcaacgcctgtctgaaactaggaagtcttttgcagcagtatattttgtttgtagcaaaacatcttttactgtgcactcccagaatcatgatcccattttccaaagtgttagttctgaaaatataaccagctgaaagaaattcattcctttacataaattaattttgcagaaaatttttcgtagacacctcccttaaaggctaacactaaatgagatacag

SEQ ID NO: 1499 - DNA, 1800 bp, artificial
  synthetic oligo
aagcaagtcacgtggccaagctcaagagtcagagtggagagaactacccaacgcagggatatagggagggggatgatggtacccattttgaagagatctacccaaggcagggatatagggaggggaatgatggtacccattttgaaaacaatctattgcagtaatcatagaccatagtaattgctcagaatcaggatgatttaggctaggaaataaataaaaatggccagcccatggcttctgcgtccctctaagataaagttcaaagtccttagctgtgatacatgactacctgctatatgttatctcactataatgccttctccccacctcaaaactatagagaatgggcacacagagcttttttaatggggaatgcaccttgctatttcacaccctgtatcattgctccacaccctgtatcattgctcctgctggttcaactggcatataatcccccaccctgagtcccacagactaacccaccattgatctttgaacatctttagagacacaacaggatttacctcctcaaagaagcctaccctctgctttggatagaattgaacattcatttctttggaagtcatagagccacatgcagtttttttgtttttgttttttgagacagggtcttgctctgtcacccaggctggagtgcagtggcgtgatcacagctcactgcagtctcgacctcctaggctcaagggatcctccctccacagcctcccgagtagctgggaccacaggcacgcaccaccatgcctggctaaatttttatttttaacatctttctatgttgcccaggctggtctcgaactcctgggctcaagcaatcctcccgcctcgacctcccaaggttctaggattacaggtgtgagccacggtgctggcccagatttttaattttacacctaaataactttagtgctcatttgttaatgtgcccgtctcccttttggtagactctaagatcctcaaaggtagggactatatctttcttatattcatattttccttccttccttccttctttcgtagatggaatcttgctctgtcatccaggctagagtgcagtagcgtgatctcgggtcactgcaacctccgcctcccgggttcaagcaattctcctgcctcggcctcctgagtagctgggattataggcgcccaccaccattcctggttaatttttgtagagacggggtttcaccatgttggtcaggctggtctcgaactccggacctcaggtgatccgcccacctcgacctcccaaagtgctgggattacaggcgtgagccactacgcccggccagtattttcatgcatggatagttgttcaaattgatgctttggcagaggtggtggtggggcagtcattggagagtcctattccaccatcctgctccgacttcccccattttatttgctttgtgaaacaacaagctggaaatactgaaaacttcatagcaaactttgtgagaaagaaacctactactacttaacactgaaaacagaaatatatagctttgggccaggcacagtggctcacgcctgtaatcctagcagtttgggaggctgaggtggatggatcacctgaggtcaggagttcaaaaccagccttggccaatatggtgaaaccctgtctctactaaaaatacaacaattagctgggccgtagtggtaagtgcctgtaatcccagctactcgggaggctgagtcaggagaatcgcttgagcctgggaggcggaggttgcagtgagccgagatcgcaccactgcactctagcctgggcaacagagt

SEQ ID NO: 1500 - DNA, 1050 bp, artificial
  synthetic oligo
gtgatcctcccacctcagcctcctgagtagctgggaccacaggtatgcgccaccaagcccagctaactttttttgtttgtttgttttagtaaagacgaggtctccctgtgttgccctgcctggtctcaaactgctaggctcaagcgatcctccctccttggcctctcaaagtgctgggattacaggcatgagccattgtgcttggccgtgttttacttttccaactgccaaatttgatccagtgcagttacttaattagattagattactgtttatattaaactcaaataatgattaaattgaaaaatttcgtgaaaagagctcacaaatgaaatcagccgaaatcagctagtgcttgtcttaacctatccttggctgtgtatgctgccttatcctcagagggcatacaaggctgagctgacagatgaatgacccctgttaatggagtacagatagttcacagaagccatatgtgatcagcagcacttgcaaatgtctcgctttcaatgctgccgcatggcaagaacacaggtggtgtcctcaagaggtctccctctatgctgtttgacctccacagcacactcttcacctgcagcttcagaatccaaggtctatccagaagacaggatatttttttaaaaaactttaaaaatagagatataacatacatacagttgtgacagctagtcagcaaagatggctccaatcttcatgctgtggcaatcccctcccacattgagtcaggctggcccatgacttgagttaaacaagagaatgtggcagaagtgaccgtgggccagttctgggccaggcttttagaagcattggtaggttctggttcctttctcttggaacacttgtttttgggagccctgtcagtttggatcatccaagaagcaaacaccaagactgaattatatgtgcaggagatttattaggggaaatgctactgaaggataaagggcccccggccaaatgcaccaatcttatgtgcaaaattaattgaagtttttgccattactttcaacggcaagagccacaattactttt

SEQ ID NO: 1501 - DNA, 3150 bp, artificial
  synthetic oligo
gcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattca

SEQ ID NO: 1502 - DNA, 1200 bp, artificial
  synthetic oligo
tccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatg

SEQ ID NO: 1503 - DNA, 1200 bp, artificial
  synthetic oligo
tcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccga

SEQ ID NO: 1504 - DNA, 1550 bp, artificial
  synthetic oligo
ttgccccattttctccttttctcaaagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagat

SEQ ID NO: 1505 - DNA, 1600 bp, artificial
  synthetic oligo
ctggatcaatggatttgggaggccagtcctatcctcagcttctgggtcattacagctagagcactcccagcaacagctcctcacacaccttccagtctttgatttttctttcttgtagttcagatggtcctgtttcagggactctgtattctggatacaagattttgaaatgtgtcttacagttcttccccagctgcccaccaaaccgtgttctcaccccagcgatcggcatcgcttggaaaactgtcttttcatttgttcctcagatgaacaggttttcctgggcaaaacatcaccactggaggtcttggctttttttcatcataaaggaaccccctcgggtggctgaatggtcccctgggctggtgccaaagtagtcactacccccaagttccagtctgacttggttcatagtgcctgggctgccctggggatgcctctagtgggcatctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccat

SEQ ID NO: 1506 - DNA, 1050 bp, artificial
  synthetic oligo
agaataggtaaagtggaaggggtatttctctgcattatttcttacaactacctatatatcttaaatgaccacaaaattaaaagtttagtttaaaaaaacctaccactagttttacattaaggacgttgatggatgtagattagacagtgctactaataacatgtatcatttcaaactcaccaaacttgggaggaatggagagcgataaagaggcgttaccttggctacggccccttcctgatgaaggtgggtaattcactgtctgagtattgttttttacgttagttcctgctgtttctggcatttctgcaactctttcaagtactgaaagaaaagaactctcaactatgaattttatactgggtgaaattgtccctcaggaaagaagggaaaataaaaacatcctcacaaaatggaaaattaaacgaatttgtccctcgcagatttacccttaaaaaaatggctatacgaaaaccttcaaacagaaaagatactataagagaagaaatcttggagtatcaggaaggaagaaagaatgatggaaagatcagaaatacagatgtggagaaattggatcactcatacattgctgttggaaataaacaatagtacagcctctctaggaaactgtttggcagtttcttataaaactaaacatgctagtaccataagactcagcaattgttctcttggcattcatgacagagaaatgaaaacttatattttcccaaaaaccagtacacagtacatgaatgttcaaagtggctttacttgcattatccaaaaattgaaagaaaaaaccagatgtccttcaataggtgaatggtttaaaaaaaaaaaaactgttcctatctgtaccatggaaaggaaggaactattcatcaatagaaagaaagaaactactgagaaatgaaaacttacatttatacaaaaatgtgtacatgacaattcatagcggctttacacccaatagacaaaaaataaaaataaaataaaaacacaaaaaacccaccagacgtccttcagcaggtgaatggttgaagaaaacat

SEQ ID NO: 1507 - DNA, 4200 bp, artificial
  synthetic oligo
actgttggcatgtagtaaagtgattaacttttgtatattaacctgtttcctgcaaccttgctataatcacttatgacttccaggagatttttgttgcttctttgagactttctacatagataatcatgccacctgctccatggactcttgactcaagctgttattcctagaagttcagttttagctttttacttttgcattgccaccaaattgttacaattatagttgccagatataaataattgttcaaagacagagaatatattctccccaatgcttcctgggactgtctcacacagaacaaaggagacatggcaaagcttaagtgaagggaaaatgcaagcagaagtaaacattgtggtattaccatgaagctaagccctctggtcataactaattactgtaaaggttacaggaatatttaagcaatttactggaaatggggaccagagagtaaaattttgccaaggatgaaatttaacaaaattaccatatgacatttggagtggacggtgatggccatcattgccgcctggaaaatttggttgtgtggctgtgtcatcagtgggattatctgctgtgacataagtggaatcatctgctatgtcattagtggaattatctgctgtttcagaaacttccaccatctcaatactgcaatcattgttatcatcactgtcgtcgacagttataataacaaaatctaagaataagcaaagaggaagattagattcaatatcacattaaataaacagtttcttgaggaagctaccttataaagttatagattgtttaaaaaacatattttagctgaaaatttgtattacatatttttatatctgtaatcattacaagttagttaatgaaccaatagtaggaagttttgaagtatgtatatatgtatgtatgcatatacacacatagactactatctctagtacttccaatttcgtagagcaataaatttcttctcatttaagaaatgtggccagctggcccatgccacagtgttcaatgatatgcttttaacttaaacgatgcaactggtgttaagtagacatacttgtggtgaccatgaagttctaaatttgttctctaaaaactaatattaatgtctatgatgactgataatgcagaaataaagtgcaaaagtaaatgttgttatgaaatgaattaaaactgaatctcacaaaatgtgaaataggtaatgacaaatataccagatgtgaaatatcaactaggtaaaccattttaatgaatatgaaaacacattatgcaaaatgtccaagatcaaaataagctttatttcttaaagctggcctgaaaaagaacacatttaagcttgaagtattcactcacagaccacatttaaactacatcataacttggatttattctatttatttcaaatagactaatgcaggagaataaaataattagctagtgtgaggggcatgtgatgatttgaaaatggtactaaattaggaatcacagaatgaaggttccaattcaggctctgtaattatccagaggtatgaccgttgggccagataaattgactcttttgcctctgttttctcacccgtaaaaagtggggtttttttaagagtcactctgaagtctacttaatagtcttcatggaaaaaaaatagaacattagaaaccacctaattatctaaaccaaagtattaaataaacaaaagcttaaataaattttggtatttccctgagctggaatggtatattgccaataagaagtgtgttctcaggcagggcgcggtagcgaacgcctgtaatcccagaactttgggaggccaagtggggcagatcgcttgagctcagaagttcgagaccaacctgggcaacatggcgaaatcctgtctctaccaaaaaataataataataataataataataatagaaaaattagccgggagtggtggcatgtgcctgtagtcccagctacttgggaggctgaggtaggatggcttgcacccgggaggctgaggttgcagtgagccaggatcccgccactgcactccagcctgggcgacaaaacgagaccctgtctcaaacaaaaaagaaagaaagaacaagaagaagaagaagcatgttcccaaagaaaatgtactaatactagatatgcttgtgaaataaagttaaataaagttaaaggggagaaaaggattcaaaacagaaaaatacagtataatcctaactttgagagccaaaggtaacataccaatggttatctaggtggctattactgaatagcaaatttattatcattagacttttctgtcgattctgtacaaggaactttagattctgtcatcagaagaaaataaccaaggcaactgaaagtgtatttttaagacaagcttttgtatatcaacagatctttcaaactagagctagtaaagctattgacaacaccgctaaggtttctcagtaaatatgtaaaagtccaatcagttcttttaggtgtacacataactttcccaattaaattttaaaagacattttaacacttagaaattgtttgaagatggccgggcgtggtggctctcactcgtaatccccgcactttgggacgccgaggcgggcggatcacttggggtcaggagttcgagaccagcctggccaacacagtgaaaccctgtctctaccaatacagaaatcagcggggcgaggtggcgtgcgcctgtagtcccagctactcgggaggctgaggccggagaatcgcttgaacctgggaggtggaggttgcagtgagccgagattgcgccattgcactccagcctgggcgacagagagagactctgcctcaaaaaaacaaaacaaaacaaacaaacaaaaacaagaaattgtttgaacattatactaccaaggcgcaaggctttcaattgccatcaactcatcagatgaggcacagctcacaatgagttctgaaaacggcttttcacgccgggaccactttgaggaacacacagcaaaacggggccaattacaacagccagaccgctccgtttgttttaagaacaaccactttctaaaccttcctgcgggactctcaaaggcagcccttcctttgccgccagaaccgtatcccatcgcccagcacttgccacaggccggacaagtgaggctcaaaaaggcacccagcccacgcctcgctttagaaagcaaggcgcagcaaagctgctggaaaaatcgcttttagtcaacctgaagccagtttgccgcactcggggagagccgggagggacgcgatccgccaccagccaaatcagggcctttcctcttaacgaccacgcggcaagggggccgggccctcgcacgcctcgacggcctcccccactccaaagggactccgatttcgcaggatctcccaacttccgcctctgttcccaacaccctacgtgtttctcttcctcctcatttacgtatttacaataaaacagcgaagctgcacagtctgtctctaaatcaaactcggttaccatcaaagcctcagactctatgtctcaaccgcaaaatgtctgacaggaaatcaactcgggaatttgtcaattctttagactcaaagctctcacccagtggggtggttcacgccagtaatcctagcactttgggagactgaggcgggagcattgcctgagcccaggagttcgagaccagtgtgggcaacatgacgaaatcccgtctcaacaaaaaatacaaaaattagccgggcgtggtggtgcacgcctgtagtctccgctcctcaggaggctgaggtgagaggaccgcttgaatccaggaagcggaggctgcagtgagccgacatggcgcccctgcactcccacctgggcaccagagcaagactctgtctgaaaacaaaacaaaacaaaacaaaaccaagcaaaaacaaaaacaaaaaacaacaacaaaaaacctctgtgaaagtctgagtcattcctcattcctcgcccccccataccccgcctcaccaaaaagagaacagctgaaaaaggataagctcgtcccagaaagtcagcatcaagtatctaataagcttcgaaatctcaaaatgtaacccacgcgggcaccccgggagaggcggcgggtaccacccaaagcaccccctcagaacacccggaatttgaggctgtgccccagccgctatgccaaaacgctgaacagggctgtgttccgcgg

SEQ ID NO: 1508 - DNA, 1100 bp, artificial
  synthetic oligo
acacaggcaggactagagaggggtagaatggcaaaaagaggaggggaaaagactcagggatgatgagcaggagatggctgtggcttggaggtggagacattagctgacggttggatacacgggccaggaacacaaggagaaagttcaggaaagaagctttgcctagaaaggtggtggtggtggtgatcgttgattttgttgttagtgcctcagagggtctcattaacttccaactttctgccgcagaccatagcctgtactgtgctttctgacattcagagggttcttggtagcgtagtaggtacccaattttgtgaacgttctatggagtcctgaaaaggctgtgttccctttttgaatttgatgtctattaataatgcctttacaatgataccaatatctgccattaattttgcatacatctatcaaaagctgagaacaaagtctttcattcctgttgcctttctattaaattatccataaggttcatctggtcctgctttctgctgttgattacgtgtaattgatcatacacaagttcataatctgcacttgaacctcttaccaggtagccagtcctgaggtactgactgctttttgcctctaattctccctcacctggatcagtaatatgatggtggcactttctgtttgcttgctgatgagtttctgtccagtcctttatttatttaagagacaggggtctccctatgttgcccaggctggtctcgaactcctgggctcaagcaacccttccgcctcagcctgcccagtagctgggatgacagcaggcaccaccatgcccggctggaccttttattctaatatttaaggtaaatgatgaggtaggtaaaagcctaagattgtttttaaaataaatcctggaatctttttaacgtgggcgtttaatctgtttctatgtaatgtcattacattaagttggtcttctgacatacgttatgttttttccttatgatttggctgtttctgctgcctgctaaatggcaatgttttattgccttttgtcttctacagtgatttggacatgatatagcctgtgttcttgaaattgaacaattattataacagcagtatactgc

SEQ ID NO: 1509 - DNA, 1650 bp, artificial
  synthetic oligo
agcacctaaatgctgtccggttgataacagacactccacaagtgttagttcctcatgtgcctattttttaagagggtaaaagaagtgacatttgagttgagaggggaagaatgcagtttgacagacacagaagtgcatagagaacagcatgtgcacaaagtaatgagaagtcactgcagcggccaggcgcggtggctcacgcctgtaaccccagcactttgggaggctgaggcaagtgaatcgcttgagctcacaagttcgagaccagcctgggcaacatggtgaaaccccgtctctaccaaaaatacaaaaaattagccaggcgtgtggtgaacgcctgtggtttcagctacacagcaggctgaggcaggagaattgcctgagcctggaaagcagaggttgcagtgagctgagttcgcgccactacactccagcctgggtgacaaagtaagaccctgcctcaaaaaataatcataataagaagaaggggtcaatttagacaggacttggagtgctatgctaaggtgtctgaacttcattctgtggggaatggggacccattgatggttattaagcagaaaacttgtagaaacagttgcagatcccaccacccctctagctgctgctaccactccaagggctctgcccacctctcctagtggaaacgtgatgtctgcaagagcagccagagatgggatgagcactgacaggggaccactggctggagcgggcagaggctgggaacagtcagggcagtttgagtttcatggtcacagggagagtgacgcacagcacagtaggcagcgagccagctggattagcaatccacaaggccaagtgtggtatcatccttttttttttcttcagttgaggtttaacctacacatagtaaagtgcagaaattataaatctacagcttaattttttacatatgcatacagccacttgttgtcaccaacaccaagttataaacatttctggctgggcacggtgcttcacacctgtactccaacactttgggaagctgaggcagaaggatcgcttgaggccaggaattcgagaccagcctgggcaatatatctcccactatacttgggactacaggtgtgcaccaccatggccagctcatttaaaaattaaattagcatacctgtagtcccaagctactcgagaggctgaggtggaaggatcccttgagcccagagtgcaatactgcaatgagctatgatcacaccactgcactccagcctgggtgacagagcgagaccctgtctcaaataaataaacaaacaatcatttcgactaccccagaaaatcttctcatgatgcctcctgctcaggtaaccattattctgatttctatcactatagattagttttgcctgttcctggatatcttatcaatagactcgcataatatgtcctctattgagcctggcttctttcactaaacattatgtccttgacgttcatccctgctggtaaagcatcaccctcattttaggaaatgttgcagacaacttccctgtacccctcttcttttttgttaaagctattgtaatttgccttccaattattttctcctccttcttacagtgaattatctttcattaaggcctccaattatattaaatcttagtcatcttaata

SEQ ID NO: 1510 - DNA, 1050 bp, artificial
  synthetic oligo
atcacgccactgcactccagcctgggcgacagagtgagactccatctcaaaaaaaaaaagtacaaaaatacaaaacttagccaggtgtggtggtgtgtgcctgaagtcccagctactcaggaggctgagacaggagaattgcttaaacacaggaggcagaggttgcagtgagccgagattgtgccaccagcctgggtgacagagtgagactccatctcaaaaaaaaaaaaaaacccgaagtttatcttaaagttctggaggtcagaagtccagaatgggtcagcccagttgcattccttttggaggctctaggggagaatccacttccttgtcctttctaacttccaacttctaacttgtcctttccacctgcattctttggcttgtggtcctttgtccatcttcaaagccagcaatctaacatcttcaaagctctctcctttttaaaaaaaaaaattacaggcagggtctcactgtgttgcccaggctttagtgcagtggtgcaatcatggctcactgcagcctccaactcctgggctccagaagtcctcctgcctcaacttcccatgtcactgggactacagaagcatgccaccatgcccagctaatttgttttacttttaatagagatgcagtatcactatgttgcccaggctggtcttaaccttctggcttcaagcgatcctcccgcctcagactcccaaagcaccaatattacagccacgagccactgcacctggccccaaagccctctttcttactctctctgaccttttcttccattgtcacattcccttctctgactttgactctcctactctcttctttccttcataaggatcctgtgattacattggacacaaccagacaatccaggataattccccactagaaggtccttaacataaacacatctgcaaagtcccttctgccacatatttacaggttccagagattaggatgtggacatcttcgggggagctattatcctatgtaccacacaacataaccataatgccacctaaataatttaaaataattttttaatat

SEQ ID NO: 1511 - DNA, 1300 bp, artificial
  synthetic oligo
gacggggtttcaccgtgttagccaagatggtctcgatctcctgacctcgtgatccgcccgcctcggcctcccaaagtgctgggattacaggtgtgagccaccgcgtgcggcccagcaccctgtattttatttgacagccctgcaagggaaaattgtcacacctgggtccaggggacgtgcacacgcacataaagattctcactgcggctgtgttgtgtcatagagaaaaggcagaaacaacttaattaggcctcttgtgcggagagatacagaggcccacccaaaccgcagcctacaaggtggtagggggtcaaaggaacgatctcatctcacttcccatctgctgggcctcccagtggcccagccatctgaaaaccaaagggcgaaggagcctgaggtttgcagtcttagccgcctgtggtgtgctggggctggctcttagccatggtggaagtatttatgccaaagaaatcagccaacactacaaaccaggatcgttatttttttccccacctacttgttaaccatttgccggcaccccgctgtcggtttcccaggcacagagcagggggaagaaggattgagacagtgtctggaaggaagaatagagactgcctagcattcatggttgcaccgcatttcgttgtatgaacaagcctccaattatgtattcattgtccgaatgaggcagcactctcccataacttcgcttcttgctggatttcagtagctggttccctcttcttggtccttcaggcttagggatgagaactgtgtatcaatttggggccaatcaggaaagagaagccacacaatcacttgaccagagaaagtttaatatgaacaatgattcattgtagcagagagggattggctagtaagaaactctggagaacctaggattagccgacaggaggagcagctcctgctaccggatggttgtgatggagcacgcaagaaagagcccttccctgctccaaagctgagatccagaccacactgggagcatgcagccctggctcactaaaaggcagagaaggcactgagctgctgcgcaggtgggactgcatatctgtgctctggaactttctgggaatcttccctctagggtgccaggcaaagcgactcactagaggctgccaaaccacctaagggggtggcaggggaacctgccggccgcagggcgatgccggctgctgtatacagcaagagccaagcactggagttgtgagtgctacaggagctggcccagcaagcatgctgcccaaaccctttcctcccgcagcatcactccctcacc

SEQ ID NO: 1512 - DNA, 1600 bp, artificial
  synthetic oligo
catgcttgtaatcccggctactcaggaggctgaggcaggagaatggcttgaacctgggaggaggaggttgcagtgagccgagaatgcaccactgcactccagcctgggagacagagcgagactctgtctcaaaaaagaaaataaaaagaaagaggaagagttggaatgggatggggtcttggaggctggctgggatttgcatagtgaacagaaagaggtttaacactccacagagtgaaattgaattttgggaagcacagtggagccagagtgcggggcctctgaatggtcagcaaaatgcatgagcatgtctgcaattagggctcaggatggagaacaggtgggagcgggctgctgttaagcccaaagcttctccccacctgggccgttctgctcgtgcctctgtccaccaggcaaagagcagcctcgaagaggacttcagagtcccgtgaggagcctggatctttctttgtagagcgtgggcagtcacaaagcttttcttagctaggcagtgacacgatccaagctgtgatttaggcagattagcttggcaactccgtataggatggactgaagggaagagagagccagagacagaagaaagtgttcccgggccaaggccattgtcggaagatgggtggaggtaatggcctgaactaggaccatggcctcgcgaatgaaaataagggaagcaatgaaaacaaactgggaaattgttgataggacttggctactgttgcatccagaagactacggagaaattaaagagggctccagggctcgggagaattgtggtgttgtaactgagctcaggtctgagccactcgtcacctgaaagccaaaaacttaagagatgagctttgttgaaaggaaagttagttttatctgagaagccagcaacctgaggcaggcattaaattagcgttgaaagaccagctttcctacttgtgcctctggatcaggggtttttaagagaaattaggggaaatgatgatcaaaacattcttgcggaccaggcgcggcagctcatgcctgtaatcccagcattctgggaggccaaggcaggtggatcacctgaggtcaggagttcgagaccagcctagccaacatagtgaaaccccatctctattaaaaatacaaaaattagccgggtgtggtggcacgtgcttgtaatcccagctactcgggaggctgaggctagagaatcacttgaacccaagaggcggatgttgcagtgagccaagatcgcaccactgcactccagcctgggtgacggaaactctgtctcaaaaacgaacgaacaaaaattcttgcgaaacatgcatggcctctgacaggcagttaataattgctttcttggtcaactttctgtggtcttctgcaggcaccatcagcatattcttatcaggccagtcagcccgttcccagagttgttggtctgcgtgttttctttcatcttcgttgaaagccctagtttcccgaggctgtttctagtaaataatctacaaactcaagcaaagcaataattatattcaagcaagcaaactttttttttttagatggagtttcactgtttcacccaggctggagtgaagtggcg

SEQ ID NO: 1513 - DNA, 4050 bp, artificial
  synthetic oligo
ccaggacaagcgcttcctcctcattggctcctaccagaagggggcggggtaaaggcgggatcgggcaaaacctgaggtgctttcccattggtccgaacgggccggctggggcggggcagttagcaaaataggctgcgcgttcgcttctgctagagggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaattggctggaatttaagctgattttagaaagtattgttgacaccgaatgatttctttctgtgcatctgaattaggtttgtttgaacgtaatggttatatagttaatgtaaaagattacacaaattaatttgtctgagagcgtttgtcagaaacaggagacagagatgtgtatagaacaggattatcgttttaggtaacatctgctggaacatttccagcttgtttctttcttgctgtagggttacaaaaaagacatcttcaccgaggctattcggaattacatgtgagtgacacttagatgtaaatttgtttttatttccttcaagtgttttaaaatgttttgttcacaaaatgtgaagaggctatatttacttgttcctgtatgttagtgttgaaggtgatagtatgatcttatgattaacaatccaattagggtccattaataatagatttttaaaaaaggcgtgctgcttttcgagaatatgataggttgagtacctagcaagacttctaatttctttttattaaaagtactattttaggattgagaatttttggcgttgacactgaaaccaggaataaggaagcctgcagcagtcttagcagtttgacaccaccagtaggtgtttctgttgacaaatgcagagaagagaacatttgggaaggaaatctttttttcggggcgggggttgggggggaggtgagggtggttgaggggggaaggagccagaagagagaagctaatgctgccagcactgtatgctgagcatttcacaagtacaaggaaacctaattagggaaaaattccgtttggctctattaaataatagaactacaaaagaggcatactaaataaagttaaccattccaagagtgttagatattatctgccatttcagagtagttgggggttcctcaattggagagggtatcaaatctctttgaattgtcttgcctttttaacatagtcaatgcagcgattaatttgctagatgtatatatatcaaacagttgagtattccagttttgttgtttagcatatttcctaagcctaaattttttaaaatcaaaatccgatatattttttttaaatttgaaatagaattctttgtccagagagtaattccttttttcctggctcagtcttaaaatttattcatgatttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcagggccgtctcgcatagatgggtaatagaaggttgactgattgcgaatcagatgtattcggttgcaaatatgctgcttggggttaaggcagtttcagttaacgggaaccagattttacgtggtgtttctactttgaaggtacagtattgttacattacaaactgaaagacagaggtggagaaattcctttaagtatcacccctagccttgtttcaccactgtgtccaggaatctatgagagactgttaacaatagctgcattgttggaaatgacagtggcttctcttgcagaaagttaacctttcattatgattttcatttcagtttactttgtaaaagaaaatttagctttatctgagaaattggctgtaagaaatttgcaaagagagcaaggaaaataggttttcttcaacgtgtctgttaaaattcacattctctccccttccgttttgataactggtggtgatctttatttcctctagatattaggtatgctaacacagtacctgatttttggcagttactgtgggaatatgacttttttatgtaataaattgatgtcaaataataatatgaggcttttaggaataattaattcacatgcatagatctaaaacatgagggaaatcttttagatgacccttcactttggtacaagaatagcacaatttgaagtattaagttgctttctaagtagaaaaagctatttactcagaattgggtaattttagattttaaagttttttttttttttttgcaacatcaaataatttggcaacatcaaatttcttgttaaaggaggcgacagaatctcacagattctttatcatctgatcatggcatcagttggactacatttcaacttaggacaataatgcaattaaaagactacatttaaactttctgtttggaggtttttctaatttgctttcaatctcaagcccaatgttagaaatcttttgttggtgacgcacaattttagtgttcagattttaggttttgatcgtttttagaatttttttttatgtgtgtagagcagcgcatggatgactgaattaatcaaagatctggcctcatttctcattcaagtttgtacatttcttcacactgagatacgagcttgggtgcaattctgttggtgggcgtgaaagctgagggtaaggaccttctacctagagactgataacatttaaatatttcagatttgggaattaatagaaagttatttattaggttaaaaggaactagcccattcaggtatttgaaaatgattgtcaatactttgaattaagctcttagaaacattggggtttgagacaatcctaatcagggtcaggttttgggtgtggtctctcttttgggcagtcttctctgtaataattataatactccatctattgagccttactgcatgccagacactgtgacacgtaatttatttgcatgaatacatgtgtgttctcacaacagctctatgaagtaggtcttcttacctcc

SEQ ID NO: 1514 - DNA, 1200 bp, artificial
  synthetic oligo
tcacctgaggtcgggagttcgagaccagcctgaccaacatggagaagccatctctactaaaaatacaaaattagccgggcctggtggcgcatgcctataatcccagctactcgggagcctgaggcagaagaattgcttaaaccggggaggtggaggttgcggtgagccgagattgcatcattggactccagcctgagcaacaagagcgagactccgtttaaataaaaaaaaaaattttcacacacagtatcatttcataatgctttttgtattttcaaaagttcttgcctatgcataatacatagcggaatttaaaggatcataactgcaaatgatataaattaccttgtgtttgtggcttaaattttattttcatttgatcttttttaaaccagcaaataaaatacaacattcttggtgatatgttgggaatgcagggaaaataaatgaaggtaaaagtaatgtaattattgtgcaagaaaaagttactttcaaatgtaagagcacagggaaacaattggttttcttgattttaagctaatgacattgtgcattttgttgtttggacctctaatcccccttgacagatccatgcctaatgcgcgtgtcgtagagcaggcttcatcaaatttaggtatttagacactgtgtctacttcagactggattgtgatgggatttgcaaacagcttaacatgcaaggtactgtaactgccttttcctgcctgcatcattttcttcttagttaccttctagggtgggctgaggagtaaggccagcttaggaacgggaagtctcatcagcacaggctgatccccacttgtgcaggtttcctcctttgctcagtgtattgcttgggtagacggacactgcttagggatgttatttttttgggtacatataggagaggaatgtaatggtttggttagaagtaaagtgttttggaaaatgtatctaattttctttgcttttagatgaacatttctctatggaaagtgacccttatatgtaccaggcaggtaaatcaataactccttgtgtggttggttgtgtctggatttttaatggcaaacaggttagacacacggcactggtctgatattaatattttactgtcagttcaatcgtaactggtttgaaataggcataggtaacatgaagtgccagtgtaacttgattttgatagtaagaacaactttgg

SEQ ID NO: 1515 - DNA, 1550 bp, artificial
  synthetic oligo
tggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataa

SEQ ID NO: 1516 - DNA, 1550 bp, artificial
  synthetic oligo
agatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatc

SEQ ID NO: 1517 - DNA, 1600 bp, artificial
  synthetic oligo
ggaatggattgcataatggagctgtgtgtattgggcgctctggtccctccccaatccctgtgttcatgagggtggaagcccagatccgccttgaaggtaagaactgtgagcagaggaaactcccctaccttgggcttttggtcatttgtcacgtatagcctctcagggcaccgggattctcacccaccgcactcatccctgccacccagtcacccttgagaccctcagctgcctccccagggctctgaagtcctctttggcgatgatttagtggaaacttaactaggaggagctgctcccttctgcattcaaagccaggctttaggaaactgtatgtttctgtcttgaatgtggtaaagcaaatgaattttcaaattatcagggctgctttgtgttcccctgagactgcacctttcacagtatcactgagacaaaaaatgagcagaaaattacccctgctacttaggcttttgtaagaaaattcgtttcggggacattttctttgttctgactttctctggccctgagtggggaataagttcatttttatttcattgaaatcagaaagctatatcttaaaaaaaaaaaaattatctacccagcactgcagttacaattgctttgcgaaatatagccctgtccatctcggtggtgtgtgagggggtcccctacggcccgctctgtgccagtcaccccctggcaggcgccgagctgaggcaggcatcaggcacacttgctgacgcactccagcagctccatccggatggcaatgcggacgtgccagcccagcgggatgaggcggatgaagcgggagatgatggggggccgcagcaggttctgaaccgtggaggtgcggtccgagttgccatagaagacctagagagatagaggaaatcctgtcaccatcacatcggggagggaaaaggaagaagggttcctttctggagctagccccaacttttaactatagaaatgattaggaagtagttaaagcagtttgcgggtgccccccaaaatctgaccttgagtgattgtcatcacacctacatgcttgggacatctggaactgcaccatccaatagggtggccactagccaatatgtctgtttacacttcaattaattaaaattagataaaaattcagttcctcagtcacatgagccacatttcaagtggccgccatattggacagtgcagatgtgaacatttccatcacagaaagttctattggagggtgctgctagaaaatgccacttgactcatcgcttttgagtttttatcctttgcattttgacattttgaaaaggcccacatcacacttacatgttccaaaggtatccaaagtagggctcaagtgaaaacccgtgcttggctcaggagttgtaagccaaaacttaaatgtgtattcctactttgatacaagtgatgagtacctttccaacttggaaaatgtttttttaaaaagacataaaaacttggccaggcgcagtggctcacgcctgtaatcccagcactttgggaggcggaggcgggcggatcgtttgaggtcaggagtttgagaccagcctggccaacacacagtgagaccccgtctctacta

SEQ ID NO: 1518 - DNA, 1250 bp, artificial
  synthetic oligo
atgcctcagagtgtggctgaaattgcctttgggagtggttgaacatgtctgtctgcaaaacacgcaggtgcatggctgttagaccaccagcccctgccctctgcttgagactcccagggtgaacctttctgcgcatttcactctcttcacacctatttgtgtttccctcggttggtgacattcctgcctcgtgcagagcactgacccatgtggatctagaagggctttgacaagtgtcaagccagataaccgttgaagcaactaagttgtttttttagctacattcctcataaatcgtggaaacctatagtagttccccccgccacctccttttttccttttagtgtgtattttaattagctttgtaggacttaagccctgggccaccttctcttccttttccagacttattccttgggtggctcctgacttttcacttctatcccacaccttttctaaaccccaaatccagagagttcagttgccagctagaggacttctgtatgcctctcagcatctcagatgaaacacgtcccaatgtgagcccctaagtgcccccaccccaccctgctttcagaccccacgtctctgagttaaccccatccttgcatgtgtccatgccggccacctgagaaccatcctgggcccctcctctccacctccagtgcccaatctatctattggctccatctccaagtgcctcaaattcttctacttctgtcggtctccaccgccaccactctagcccgtgtccccctctttcttcccacacctcaactactctccctggattgctctggccccacaggaaccagagaacttttcttaaaacacaaatgtgcttgcgatactcttcgacttaaaatatttatccggcagagtctgctaattatcacccgatactcccttcccatcctcatttggtaatagaacccctgagtttcatctgggcaaatggccatctggctaagatggcatttcctagtctcccttgcaactagatggggccccctaaccaaactctggtcaatgggatgtgggcagaagtggccaatagaatatgtttgtgttcttaaaggcaagtcatgcgcactctgctgctcttttgtttctccccactaactagacggtggatgtgatggcagaagacagagacaccattctggaccccaagatagacgcttcatgttaaggacgacagaacaacaaggtagagtctgggccccgcatgccatcaagctgccataacg

SEQ ID NO: 1519 - DNA, 1200 bp, artificial
  synthetic oligo
ggtttgcagaatgaccttggaattatattgtcaccagtctttccaaatactgagaaatgtgactaagtaacaaaagtcatcagcctgggaaacatggtgaaaacccctctctacaagaaatacaataaattagccggatgtggtggtgcgtgcctgtagtcccagctactagggaggctgaggcaggaggatggcttgagcctgggaggttgaggctacagtgagccgtgaaaccaagaattctgattctacttgtgtgagtttcgctgtgtctgtctaccaggtcatttgcagagcacagagacctccttctccctgctttttaatttattttctataacacacaaatacacgatgtccacaaagaagacaggcaaccaatttctaacatctggatgaacctgaggagaaattctgagcagatgggtacttgagaattgagagaggcatgaaagaatattatttcaaagattgagagggaattggaactggatgacattttacagatttgcccttattttttcctaattgaagcatatcacttctgctagggtcatatttagaaattttaaaatgagtgagtgtactgagtctccgaggtttcctgactctcagttggattatgttttttattagattccagtggtactgggtatgttacgttaatccatatttaaactaggttgaccttacaccccaatttgccctggatggtcctgggttacacctgtcgtcccaacagaattattaatagcatcgtcctccaccgtcaatagcattccggtttggaatattaaattctacaatcactcccactttgactcctaaaagttttccagaatatgccatactttctcattaattgttgcaacttatggctattttatagatttctgagacccatcctgttttctgttggattttaagcatcctttgaactttagaaggctcctcacagaactggaaagccatccacacaaagacaactgttgttcattaataacacatgttagttaattaacgtgttgctaattaataatatttatattattcaggctatattcctatttatcaacgatattaattaaattatgtattaagtatgcaatgaatgtcaatggttgaatagcacataccttcatagccaaagagaagtaataacaaaaagccttctatcttgcgtgacatcttcccctcgtc

SEQ ID NO: 1520 - DNA, 1600 bp, artificial
  synthetic oligo
tagattgtgggccacgagatgaccagagtggccagccaccggccggaggatacgttcctgagagctccacgtttcccactagtcagtgagcctcaggactcctgggaagcctgataataagtgtatcccacctgtttccaacccctagcggtcgaaaacaagactgccaggaactggccctaaagttacacccactggttgtgttttggatggtgtctctaggaaatgctttgctctccagccccccacatcccgatttttctgtctgcccctgggtataaaggtatgtttgccaagttcccacacttaacctctgtgcagaaaagaagctggtgtccctctgttgcatgcttaacctctgtgcagaaaagaagctggtgtccctctgttgcatgcgacacaggtatctgcctttggtgaaaaactcttgttccttttctccattccaggagggaaactgtgttctgttctccccgccgcccctcgcaaggtgtcatcacaatctttttttttttttttttttttaagacggagtctcgctctgttgcccaggccggagtgcagtggcacgatctcagctcactgcaacctctgcctcccgttcgagcaattctcctgcctcagccacccaagtagctgggattacaggcgcccccccaccatacctggcctactttttgtatttttagtagaaatggggtttcaccatgttggccaggttgatctcaaactcctggcctcaagtgatccgcccacctcggcctcctgaagtgttgggattgcaggcgtaagccaccgcgcccggccccacccagctcaaattctgtggtcatttttatcacttgcttgtttgccctttcatttcttccttgtgcttgttggtaaaaccacaatctcttacatctgactgtctccctaccctgcccctgaacatggcccaagaagaacacatccaagctgactggtttcacactaaattcatgactgcttagctcaagtgaaccctttctgcagtccagaatacgtgtccacttctaaggacggtttcatgtcttatctccgtaaacctcctgtacccccaaccctaatctcggttacagctgatgatctagcttcctattgcggtgaaaaaatggaagcaatcagaagagaacttctggaagtcccctgccagccaccgtctgctctcgtgctcttcctctggatcaggatgggttgggactggctaactctgtcgtaggaggctgtcccgtgtattgtaggatgttttgcagcatccctggcctctattcactggatgcgtgtagcacacatcctcccccaccacccagttgtgatgacccaaaatgtcccctgggggacaaaatcttgggagttctttggcaatatctggagacgcttttgttggttatgactgggagaggggtactataggcacccaggagggagaggccggggcgctgccaaacatcctgtggtgccagctactctgggggagtgaggcgggcagaatcccttgagctcaggaggtcgaggctgtcgtgagccatgattgcaccgctgcactccagcctgggtgacagagtgagaacctggcaaa

SEQ ID NO: 1521 - DNA, 1050 bp, artificial
  synthetic oligo
caaggaagttaggggactatttgctagccacctggttagggaacagaatgctggcctaatgataataataatagctaacatttattgaatactatgagccaggcaccaagctgctttatagttgtattggttagagaatgtgtttggctgcctgaaataaggtaaatagaacaccaggggcttaacacagagcgcttggttttcgtcccacatgatacgaagccaggagatatacagtgtcacattgtcatccaggtctcaagctcgtccctccatcctgcatccatcctgcatcatggtttcgctattctcagtgtgaggctttcttcctagtgtgcatgagatggctgctcctcctccaggcattgtgtcctggttccaggcagaatagggggaaggacaaaagagaagaggcttatgccagctgagtcttttcctttttatcaggaaaatagcttttctggaagcctcagcccatagatttctgcttgtatctcaagggctagaactgtgtcacatgactacccatagttgcaagggagcctagcaaatcaagttttgttgcccgaacactgccacctagaacaaaacgggggttttattagtaaggaacagggggagaatggacagtaatgatcagtggctgctacaatgtgtgttaacccattcattcgttacgtcaacccagtgtgattggtgctatctgtagcctcgttttatagttgaagcaataggcacagagaggttatgtaatttgcccaagctcacacagagctgttaagtggttgagcaagaacttgaacccaagcaagctgactctagaatctaattctattatgtccctagacacatcctgacccactggccagaccacatttcttctctaggatgtatatccacttgggaaatgcaggcctctcctggaaatggtagctaatacttgtttagcactttatagtttacaaagagattgccacttaaattattctctttaaatattcttctttttttttttttttttttttgagacagagtctcactctgttgccc

SEQ ID NO: 1522 - DNA, 1300 bp, artificial
  synthetic oligo
cttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatct

SEQ ID NO: 1523 - DNA, 1850 bp, artificial
  synthetic oligo
accattagaaacttttacaatgagaaaggcactggcttaaaagcttgcatatcaacgtttacctttgtttaagttgcttttcctgtccatctttttttttttctgagatggagtcttgctcagtcgcccaggctggagtgcggtggcgtgatcttggctcactgcaagctctgcctcccgggttggttcaccccattgtcctgcctcagcctccccagtagctgggactacaggtgccggccaccatgcccggctaattgtttttgtatttttagtaaagacggggtttcacagtattagccaggatagtctcgatctcctgacctcgtgttccgcccacctcggactcccaaagtgctgggattacaggagtgagccaccgcgcccgaccgggcaaatgaatcttaatgaaagcaataagatctgcttctttctgtgtgtatgtttgtatatctatgtgttatgtgtatctgatattttcataccaaaatatataaaagagctctatttaattggcttaaagaaaaagtgtttaaagtcattaattataaagcaagcatatttttcccctaaatttactagtcaaacaagcttattacctcttagatgtataataaagctataaagccaaccaaagagcaaaatacatgaaaaaaaaaaaaatcttgatacctatcagtcatggtgatacagaagggctgggctcctggctaaacccaacccataagcctggaaccttggccctaagtgaaaacagctgaccccgtttttttccagccaaatgttgccgtttttggcctgccctgcccctatcctttgccgatgaaagacttcagctggcagagcaacacaagtggctgaatgtcaaggatacaagcagctgagtggtgagcagagaagcagtgcgcgtcagagactatggatagacacggctaacttcaggcggtgcggcttcggagaggagcccagccagagacggccgggcttcagggaaagatcaccctcccatcccctttccagcctccctttctgctgagagccacccaccgctcaataaagtctgcattcatcacctttctaacagttcatcggacatgaacccaggttctgagagggcagggtttgccaccctgaccctccactgacctggttggcacttggccatccccggatggcagaactgaaagagcattggtcgtaacatgcttggacgctgctgcagggcccacaagagcctgctcccaccagagaagagtgaccagtcggtcccaggattcatttgctctggttcctgcactcactcgcttgcacgctccctcctgccaagagtagccagtgcgggctgagtggaatgagctactccagtttccgcccacgaaggagttcaagagaactaacccgtcccaataggaaagggaaaaaaagcagagtggaagaaccatgtttaacctattaatctttttgcttctgtaatacttatagtttcctgatttttttgaaaaataacttgaggtgatggctagctttgcttaatgaacaactcaagcataattgttaaaaatgagtaaattaggtgtatgtaaatggtatacaaattgataaatgaacttttcagttttgaaaaccttttaccgtaacttaaagtcctgttatgattaagtaatattcatgaactgtctgagtcatttccaattaagttagaatactgaaacattaatttgaacgtaactttaaatttatttttggcttcttaaattttatagaaagactaaatatggctgggtgcagtggctcatgcctgtaatcccagcactttgggaggccgaggtgggcggatcacgaggtcagga

SEQ ID NO: 1524 - DNA, 4350 bp, artificial
  synthetic oligo
aaaaaaaaattgaaacatttgctttttcttcctaccttatcctccagaatttggaaactattcatgagtattcttatttttatggcaatctggttattcacataagttcaataagcatttgcttgctttataacaggatacaattgacaacactggttaaaatactaaggctttgactggactgtcatatttgagaatgcgcataaaatgcctgctttcaagggttcccagccttacagtgtggaaaaaaagtcactctcaagatattagatactgcaggcaaagtctgatgtctgccttagtttggctttttattattgagtggttttaattttaattttaattttattttatttttgagacagtctcgctctgtcgcccaggctggagagcagtggcacaatctcggctcaccgcaacctccgtctcccgggttcaagcaattctcctgtctcagcctcctgagtagctgggactacaggcacgtgccaccacgcccggctaatttttgtattttttagtagagatggggtttcacaatgttggccaggttagtctcaaactcctgacctcaggtgatccacccacctcggcctcccaaagtgctgggattacaggcgtgagccaccgcgcccggtctattattgagaggttttaaaaagtccagtgtgggactccttacaaaatttccaaccaagcagcttttaaaagaacctaagtgattattcttgctgcgtttatgtaaaacaaccaggccaagtttaatgagagtaaacttattttgcaaacaaattagtttacctctgattagtaggaatgagagtgactgtagagagaaaaattgtgtttcagaagaacaaatgtagtaccccgttactagatcatagccctgttcactgtgtttgagtttttattatctacttgtagactggacttgtttctgaattctagtttcctccaataactggctataaaactccaactaagaacaaaaactgctctgttcctaaagccctataagctgaagctgaacaactcattgtaaatttgggaagggacaagtctcatgcctgatgtgtgggccacacaaagagttcaccagaatgcccaatgttacaaccagaaacattgaaactgcaaaccaggatgcgaagctgccaacttcacactgtggacagctttcccgagacaatcggaagaagcctccctatcctaagactcttactcctctgaatttttctttgcttattcttacctctttcacttggcagaatgatgccgtagttagaatttcagtcagtagcttttgcaggtcacttgcaaatggtcactctttgctttaatttcacccagtcatgggatggcggataataaaattgctgcctactgccatctgtacagttgctaacacttcttgttgctcagggataaatccatcaggtattggagactcagttgcaaaaattaacaggctacttggttatgatggtagacccctcatctggctccttctttgatctacttaattttagttgggttggtttatgggaaccttggctaagaaccatactccaaattctaggtattatcctcctgatagttacaatagtagtctccgtagtgcactgtatcctctcaaaaagttttaaatgtttgaacacagccatttgtcaagcatgaaatggtctctcatctgctggaatgacagaaactcagagaagtgtgtgatcatgaagataccatcacctgtgattgatatattgagactagaaacccagatgatggtaactgagagcagcgctgatgccctaagttttggtggcactctcacctaggggagagcctgatcaaaagaggagaaaggtgttaaacaaaaatctggaggaggccattgttttcaactaagcaacaaacagaccagactaaaaatcaaagtggagtcactcatgctgaagtgccacatcaccaaaccaaaaatgagttgttagctggccttccaaaaaatcaggatagtgaaacagcctcatttcccaaatgggccaatttccacccaagtgataatgaagttccctctgcctttaatccttaaaacaaaaagtaatctgaaactggccgggcacggtggctcatgcctgtaatcccagcattttgggaggccgaggccggtggatcacttgaggtcaggagtttgagaccagcctgggcaacacatggtgaaaccccatctctactaaaaatacaaagttagccaggcatggtggcaggcactgtaatcccagctactcaggaggctgaggcaggagaatcacttgaacccaggaggcggaggttgcagtgagctgagttcatgccactgtactccagcctgggcaaaactccgtccccccgccaaacaaaaaaacaggaaaaaaaaaagtaaggaaaagaaaatgtaatctgaagtaacctggtgttaaccaatcaattccaatcagttatttgtctagtgttctgtttctctgtttctaccttacaaggaaagtaacttggaggagaccaatctgctttcactctttggttccgctttgctttcttcagcttttctctgtccataccaacctcctctgctcaactcattggaacacttactctaattttatggaatgaagtgttgcctgattctagaatcacaaagccaagtaagatctttaaattgtaatgttgccgtgagccaccacgcccggccccatggactattttctatggaaaaatataactcaagaacaaaaggagtgtctgaagagacatataaccattaaagaaagtgatggctttgtaattgtgtcagtttggctaggctgaactacctttctcagaattccctctcttgtatgtttctggttagggtgggccaggagatttgggaggtaaaaggaaaggagttgctattttgcagcttacacatgctgtggctgatctgcagattcacctcattggtgtgaaacagtagctaggcctgcaattgctctacctacccctggatcctatcagcttctctgatttctgggctgtgtacatgtgtttagctccatgaccgaaagccttggcttctgcagggcaactcgatgaccaaggtcagagatggtaagaaaggacacaggcttcagttcatttttgtggggtgccagcttgtgcttgtgggttttagcctgctcgtgatcttccttcctgactacctgccctgtagactttgagctccagcatcagatatggagaccacatctggtttctactggttatctacctataaatcatcaatcacctatctgcctacctacctatctgtatcttcttctggttctgcctctggttgaacccagactgacacagaatttggtactgagagtagttccagaagaacagaatcttaaagataagtgctctgaattggttctgggttttctgaaattggttccctactctgatttgatttaaaggtacgagtagccctgtttccagtgctaaagaggtacttgtactccacagtgtgaagtggcaaaatagttactcaaattatcaccttcagatacttgcgatcaagtacctatagaaggcaaacctctaggagaacaagtatttgctacttttaacattttagtcaaaaggatgagtataatagggttggttggttggttgtttactgaagaacttgggtaaagaaagtgatcagctcaaggtctacataaaggacctgaatgtttctaaaactaccaggaaagaaactcttatctcctatagccacaaggcttagatttctgaaagccaaacccgaagtctaatcctgtgaatgcttgaatgacaatacaaattgaactcccaacctcttagggtatgttgctgaaaggacaatgattgggaaggaatggcagcctgaaaattggaatggagaccggttagaaatgcttgttccccggtgccgtaaacaaccagcacttgaacataaatttaatttcctcagcaaggccattttttcactttctgcagaaagggtacactcgccagcaattttgctgtaagagtacaccgaacagaggagacagggtcatttaacctgacgtgtccaccctactgctgtgtctggtttccattggctggaatgggacctcaaattctgtatttgtcctgactggctagcaacttaaacttttttgtgtgtgtgtttttttttttgtttttgagacggagtctcgctctgtaacccaggctggagtgcagtggcacaatcttggcttaccccagtctccgcctcctgggttcaagtgattctcctgcctcagcctcccgagtagctgggactacaggcgcatgcca

SEQ ID NO: 1525 - DNA, 1500 bp, artificial
  synthetic oligo
ttttagagtagtttataatgtggcaaaaactaaattataaggaaaaggatatctacaagtggagtgctatcctaacaaaaactgaaatatgtgtcagtaattttaggacaaggtgttagtgtgcctggaccaaactgaggatcgggctgctatttcttgtggcccaataacgagatgcagttgaactggagaggaagagagttcttatttctgcaactggctacagggagaagacctggaaattatggccaggccaattcaaaattacaaagttttccagagcttatataccttctaagctgtatgcctacgtgtaagtgtgcactcatctaaagacataagtgattaacttcttttaatctgtaactaaggtctgagtcctgaagaccttcctctggagcctcagtaaatttacttaatctaaatgggtccaagtgctgaggtgattacccgtatcttgtctcctgctaaatcacggaggtttggggagttccttcagacccccagtaaacttgtttgcagaggcctggggagtttcttcagacccacaataaaacatgtttaatcctaaatgggtcctgttaagaattccttcgttattttgtcatgctttaaggcccagggaagggctaggcaaaactcttggtgggcttttgttacattccagcctttgtataagggcactggctttttagcttttaatatttaacttaaccactcagtcagtattgaaacagttgttatggaggcctgtgttagtgagacttggcctgccacattagggcagaggctggaaaagcagtgaggaaacagcaaaacctggaaaattagctaggaaactgctattgcaggctacaaaacatggttacacatgttatgtggttttgaaacaatttccaaaagtgtagtttatgataatatggaagatggaaaagcttcttaatgaaatttggatttgactaaggaggtctacaggcaaaatgttgaaagtgacagctgattggtcctagctgtgtataatagagtataagaaaagagagatgagccaaagcaaaaactgttcagttttcaagcaggatttatgaggaatataaaggggccagggcaggctgagttggaaaataaaagtacttttaatctctatcatccagctagaagattttcaaagtaaatgaaaacctgaagtcaacttctacttctggccaacatggagtaacagggaccagatgtatcctcctgatacaacaaaaacaaaagacagaatatctgaaacaattatttccaaaacactgcacatcaggcactaaagaatagtcatcctggagagatgagaaatgaatgaggtaaaccctacaattgctccagcttactcccttcagagagtttacaggctgtggcacagggaggggaaactcaggcaaagccagaagaatccctaaattgggagtccaaggtggctagagtttgtaggacatagtcctgaagaggagacagctgcac

SEQ ID NO: 1526 - DNA, 3600 bp, artificial
  synthetic oligo
gttaaccaaaagcagcacagagatcatgaaacttcattctaacctgagctttcaacctcctccctctcatcaaattttacttaaaatttcagaaactagcaagagtcgaaatggcccgatgtcccctccttctgtttcccctgccgcttgtccccatggccctgggggcatccgcaggagggaggtgcccctggggctggggagaggattctcctggcgtttgctctttttcctggctgcccaggtacactcttagccatgtccagtcctcaggctttccccaaaagggagaataacgggagcatgggccaaaatcctgagtgaaatataaaggccccagataaagcaattataaatggaaactctgaggctgtgattcactcaagcaacatgactcatgttctgctgaggtttccgtgaacaatatgttcacagtctgatttaattatagcctagatttactgctgcctcggggagcctccgaagctcaccccatccctcactacccccagcgcggcgcctggtgaaacgcctcccagtgcgagagtgggagcaggcactggaaatggttttctgcaggtgctatgtgtcacatcgtgcacagtggacagctcttgggacctcagctgggcggggaggcagagtcgtcaaataagttagagctctggggtacagctcaagcccccggggatgggggggattgtgcttcctgggcttcccctccgtgcaggggctcctgcagagttgaggtttgtcagcgccgagtgtgggcgcctagagtgatcgattgagagagagaatccagtcacagctccctcacgcgagggtggagggaaacccggggctgcctgccgaactcgggggcgttctcgcggggacccgataacaccggacagaaaatgtcccacttctcatcgctttgtgctttcagtgagaacccccccggaggtacagcatttaaaggggataatttcaaacgtggtgatgtggccacaattatatcctcgttatcagacaaaaactgtaggtcccctccctctgcaaagcacgaaagcatttgtgtgtatttcagtgtaacagaatgctgtcccccagtatctggtgccatgtgctctttccacgccccccgcaccccggccctgtttgcttgagtaaccagagtggaagagggcagcccactactgtgggctttagtgttgtcagctaaaatacaggccgccccgttaatttgcatgtcacataagcgatgcataatagtttcatttgcgcatgtcccaaatattgtccgggacatgcttgtgctaaaaccagattccttgttgacctgaaatccaaatttattttttgagacggattctcaccctgtcacccaggctggagtacaatggcaccatctcagctcactgcaacctctgcctcccaggttcaagcgatttttctgcctcagcctccaagtagctgggactacaggcgtgcgtcaccatgcctgcctaatttttgtatttttaggtagagatggggtttcgccatgttagatctcccaaagtgctgggattacaggtgtgagccagtgcactgggccttaaatccaaatataactgggtatttttttgtttttttttttttttttgaggcagagtctcactttgttgcccagactgtagtgcagtggcgtgatcttggctcactgcaaccttcgcctcccaggttcaagtgattctcctgcctcagcctcctgagtagcggggattacaggcgtgtgccaccatgcccggctaatttttgtatttttagtagagacgaagtttcaccatgttggccaggctgctctcgaacccctaaccttaagtgatccacccccacctcggcctcccaaagtgctgggattacaggcctgagccaccgtgcccggccggcgttttgtatttttagttgtcaactctggcaaccctacatggactttgaagtcatacaacctgatttcagatgcccctctgccatcaagggtatgggaaactctggacaaatgacatgggcattcggagcctccatttatcgtaaccacaaccacatcccgggaccatagcaaagatgagagcgaatgtacgtgaagcacgtagcacaggaagcggtatctcgttgtagtggaagctgttggccccgctgcatcccctttattggccggtgcactcatcctccagcttctaggaatgttgggtgccagcaacgcacagcgaccccctttcctggtgcattgccctggactgatgggaggtgcttgcctaagagcttgtgtcccatccgcgtcccccccaactgcccccattgccacccgcgggcagccagcagtcactggctaactgatggcagaggctgcttttatcttgcagtgctcactccagagccccctgtggcgtcgggctggctgggttccacctgatgccacaccctgctcagctccttcccctgtcactcttgcttccttccaggctgctccctggagcacactcttggcatttcacttgtacaacatgcctggccctggcacgctgctggtgctggtgtgcacactgatcacataagcttgtgagcattcagcgctgaaggccaaggatgccttgtgctctgagaatgggatctgcttgggggcaggagagacttggggtcggggtgcgttgctggggaacagacaagggatctgtcgcctcctgggaagctgggaaatggtgtggggtggggcgactgggagaggacggccagggacagcttcaggcctggtgtcctgcaaaacctgacacctagcagatgggaagatgcggctcagctacctcctcccggagccaggctgaggaggtcacgtgggcccaggaggttcagcctcagttgggctgtgcttggggaaataaatcatcaggactcaatgcagaaaaatgacatgaattagggggctcgtctgggtgccacgcgaacctctccctgtctctccaccttgcaggcatgcttttgggtaccgacacatgttcctccaggaggagtggtggaaaggaggaatcctttggcctccaaccctggaagaaggtgtatagttttaaagggcaaggcttggctttgaattgcagctctgccacttctttctccttctctcccttcccttcccttttccttctcttcccttttccttccctttccctttcccgacagtcttctctgttggccaggctggagtgcagtgatgcactctctgctcattgcaatctccacctccccgagttcaagagattctcctgcctcagcctcctgagtagctgggactacaggcacgtgccatcatgcccacttaatttttgtgtttttagtagagatggggttttactatgttggccaggctggtctcgaactcctgacctcaagtgatctgcctgcctcggcctcccaaagtgctgggtttacaggtgtgagctactgcacccggccccatctctgccacttctatacaggcgctagaatccagaccagcttctgaatatctctaagcctcagtttccctgtccacagaagggggtgatatgccttctctcagagaggtggcgtgaggaacaa

SEQ ID NO: 1527 - DNA, 1100 bp, artificial
  synthetic oligo
gatgtaataaaaattgctatagtcttatcagctattttaggtactgctctcacagaaatagcacaatactgaagtctttggacaatagttaagtgaggatttaaaatgttaaaatttttaggtcatcatcaattcccactatgaaaaaccaaatcttaaaaaatcgttgttccagtatttgctctataataaatcaatttggattagtaaactttctcttctgtaagggaaccacattttgatccactagtcatatatgtattaatagttactcactttgcttagccaaaatgccaataaaggataaaactattttaaaaaataaacactagcttgagaaatactatattgagacatacataccattcccgcttgcgtgtactgagcaatcattattcactagcagtgtggtggagttagtggagttactgcttgactgtaaggaatttgaagagctggacactccttggtttacagtctgcttctttaaaccattagtagcagttttactccagtctacagcagaataagcattacagaaaaacagggcagtatgttgaagctcaaacgcaagagacagatcacagtgtaacaagtcctaagcaactgatttctcacttcaggatcttatggagaagtcaccttccaccagttggtgtgataacatgtattttcatttggattatttacatttgtccttcaaatgactgtggggttaaaagtaacctatattctcctagaactaaaggccaagctaatttgattatgtctataaatatccatagaattaggtagtgattcagagcctcacactgtcttaacaagaacacaaatagtctgtgttgtaatgactaattgttcttcactccatgaaaatgattgaactatgtgtactgccattttctgaatacagactcccgtgtcgcccagatactgcaaaggtggtattcatgcaaaaggaatgtagcttttcaaacagtacttcatttttctcattttcttaaaaaaaaaaaatgagctatttgctctactacccaaccgggtatatgtgaaaatcacttcaaaataaacaaatgtatgttacaaccaaatgtatgcta

SEQ ID NO: 1528 - DNA, 1200 bp, artificial
  synthetic oligo
cgttctgcacatgtatctcagaacttaaagtaaaataaaataaaaaactttattagcaagcaggaaaaataaccttctagggctctttaaaaattgcccaatggacaggtgtggtggctcatgatccccagcactttgggaggccgaggcaggaggatcacttgagccgaggagttcaagaacaacctgggaaacataaggagacttcatctctattaaaaatgttaaaattagctgggtgtggtggtgcatgcctgtagtcccagctactcgggaggctaaggtgggagaatcacctgaatccgggaagtggaggctgcagtgagccatgattgtgtcactgaacctggtgacagactgagactctgcctcaaaaaaaaaagagagagaaattgcccaaggacaaaggagtcaaaacagaaagctgtaacatatgtaaatttattaattacattttcaattagaaaaataacacattaaaatccacatgaagattaatgcagcaataatagacaacttacccattggtcgaatctttactctttccaaagcagctattacagcacatgcattcattgtattattcagttttattgtgaatgtacaatttaatgtgctgtaaggagaaatatacataaccagaatgttactaaatgggaaacctacttacatatttgtaattgcttttgcaaacttagagtgaggaaaggggacactgatactgttaacttgtgatgtcaccccaataagcttgtaaatacccatttaccacggtctgaattttacccaaaaagactttatattaagagacatttatggaggttcacattcacagaggttgcaaaccagagactctctgaccacacataggtgctggctcattttgcctgtctacacgatgaacaggcaggggtgaaacttggttgcagagacaagcaagcaccttgacacctttaatctcacccccaaaacactagctggccacttgcctggtgtccataaacatttgagtttccatcatgggtgccctttcacataccagtctagatgaacatcaagatctttttttctttttttgttttagatggagtctcgctctcttgcccaggttggagtgcagtggcatgatctcagctcactgcaacctccccgcctcccaggttcaagcgattctcctccctcagcctcctgagtagctgg

SEQ ID NO: 1529 - DNA, 1100 bp, artificial
  synthetic oligo
cttgtaatctggtggcagtcctcctctggattgaattactgttccatagagagataattaaaaacaagccaccacgcctaggcactcttatatgggaaccccaaacagaacaatatttttgttgttattacactggctcttaagggcttgggataacagacactcttccaggaacggcattttccgagtttactacataacccccaaaactgaatgaaaacatttctaatttggcatatccaaaacatgtttactcgcgctgggacactgctcaataagtactcttacataatgtatttattaaatgattaataatgacatcattaaaaaaaacttcggctcttagctgatggaacttcccaaagtgcaagcaatccgcagttctaggtgggctttggccagaacgggaagaaggtgaaatgtgttcttgagcccccagcccccaattcttgcttttctcctgccttcgcacagtatcgcccacccatccccctggctcttgatccctccagaactcatcctggttctctcagggctttatgaactgtcccttccccaagggtccacgagatgcattttggagcgtccataaatgccccgaaataaaatgcaaatgtgtgttcatatgcattttttcctgggaagattagagcccccaaagggggtctatctttaattaacaagcacttatacagcattactatatgaccgggcactgcgtaaatattagctcatttagccctcataacaaccctatgaggtacgttatccccatttcacagatagggaaatggaggaaaagagcagtcaagtaacttgcccaagattacatgtaaaagggcagactaggatgtgaggcaggctctccagcttcactacaccaggccgcttctcatcttgggctgtgggctgaagagaaggaagggccactgacctactgggtgtccaccgtgctccaccaggagggatgtgtactttaggaagaatgagagccttgaaattaactttctgaccagtagaggatactgggggatcattccccgcccttcccagtgcctctgaaactagacacatggctagcaatctacgctgctggtcct

SEQ ID NO: 1530 - DNA, 1350 bp, artificial
  synthetic oligo
tcgatggttttcctggtgaaggactggaaatacaccgggttcccagaaaccgggatctcgggcgctctgcctgctgggggtcgaggtggagggggtatataaagtgagttgtccctggtcccctctacctttctgtctcagcatctctcctcctgcatggtcatagaataaaaactagatctggataggacttacagatcccctaagcaatttgtcaaagtaccctattttacagatgggaaaatggaggctcagttctacaatacgaattagttgtagagaccagggaaaaaataagcgctctgaattccctttccggctcattttactgcccccctcccccgccgcctttatagtcgaataacacctgtgtttgcaaaatgctttgtcgttttaaaggcatcgttctctttcgttaaacctgcgggagaatataccatttttcctttacaactagaacaaaattctggattctgaattgcattcacagccctggagacgcgatggttatcaagtgcagatctttaaggcatatcctggctgactctgccattttagacacatgatgggcgagatgtatattctgctttgcaggaggggttgaatttgttttgcaaacaccagtttattaacactcacaacattctaactgaataaatgaatggacagtcttttcagagagacttttaactgattggattaagggagagtagagtcaggaagctcatccaggttacataaattaaaagttttgatgaaggggaaaatggtgtattaaataaacacacccggtattactccaacgggttaaattggttccgtttgaatgaacttaacacgtatttttaacttacatataacttttgcatattaacttctttatttttgctttacatagacctcatacctaaagaattttcatacaccgctagtgggagtgtaaatttttacaagcattttggaaaactctttggcagaatctattaaagctgagagtacaactaccctctgaccagcaattccccttctggatgtacacacaacctcaatcagtgtgtatgtttaccaaaggatatgaactagaatatcataccagtatatttgcaatagcccagattggaaatgacccagatgcccaccaacagaatggatcgcagacattgtgatggtatagtcacaaagcggaatcccagacagcaatgagactgcatgaaccactgctatgcttaatatagatgaacctctgaaacaatgttgagtgaagaagtcaggcccaaaaacacagacactatatgattttgtttctgtaaaggataaaacaggcaaaactaacctatgctgttaggatag

SEQ ID NO: 1531 - DNA, 2400 bp, artificial
  synthetic oligo
tcccctgttagagcccacagaccccttattgttctttccctttcttcctcccaggtacttaatgcactcatgaggcccctgcatggtccagcgtattccaccagctagatgaaccctggtgcctcccagccactgtcacacctcacttggatcctgcagcagtgtctggtcttggacctcctacaatctgttttctatcctagagcacaaatcttatcaggttatagtctttcctaaaacccttccttggctttccattagcattaggttggacggcacgcttctttccatggtgggcttgtcatttaacatctggcctgtgctgctctctccagcctcacctcttgctactttcctacgcacatgcaatgctctctccagcctcacctcttgctactttcctacgcacatgcaatgctctctgcagaattttcttcagttcctttactgcaccatgccttctggccttcatatctgctattccctctcccagaatactctttccttccttctttgcccaggtcatcattgtcatggggtcactcctcatctttctccaccatgaagccccctaatttccctaggctggtttctgttctcttacagccacctgtacgtctccagtcacacctccttgtcactgcttcgttggttgcctgtcatccctgactagacagaaggctccacggatgcaggaactttacctgttttgtttgccatcaatccgtccaggcacctggatgtattcttactgacatgcttagcagatttagcagaaactcaccgtcacccttggcctgatggatcttgaaaaataacaatactatctaatatttccacttcggggtctacaacattacttcctttgagacatcatgttgagaggtaggcagatgagctccactttaatataccagtgccctggggctcagggcgaaagcctcaagcgtcattgtctattcactcagtggctacttctgtctacaatacaaaaggcctcatgttagtttctaaggatacaaagatgaaaaaagaatgatctttgtacctgagaatctcaaagtctagacggaaacaaagtgtgagaagttgtaatggaggtatgaacaaaatgtggtggaaacagaaaagctactgactcgacttggggaaggtggaaaggtcacagacagtccctcctgtcttcctgcaagcttccactgatcctttgagactaacttaacctgttacccgatccttgtcttttctcctctctatccctttttgaggctccctcagttctacatagaacaaactgaaccgtggtcccatagcacacttcttttataacacctatcaagttcctcgagtctaggaaatttctgtaagtcaggaaaagcggaagtcgggcccaccagatggctgctacatgtgggctgaggagcctccagagagagaacttgatcccagacacactgagcccagtgggaaaccttagtcatcaggcaggagaggcaatccacaagctgaaggatgagaagcgattctgaggacagcaggatgtctgccactgagattttcatacctctaaacctccaatgcaaactcacagctggagtgtgagctggagggctatgaatgaaagccgaaagagctgtttcactaagaacctttaagaaattaagatattggctgcatgctttgggagccctctaacagactgagacataaaggagagatgggcatcctccccctttgtccactgcagacaacttctctggtactacagggaccccaatgagcctggaattgcccctggccaagcagcagtgacacccagccaagacttcgatgccataagtagaaagacaagcacccagtgggacgagatagattcctagggtagtacttaccaaattgtggggcttgatgcattagttagtgggtcatgaaaataaattggtggctcatgaccagcagtttttcatagactagaataggattaaaaaatcagagcgcctcacaagtagtgttttatggaagtaggcatatatgtatatgcaagtatgtgtgcatgtgtgagtatacatgtataaatgtactgggtcattatgtaaaatatatcccttcctgtggaccatggtcaaaatcacaaagggattgcctgtggaacagtagtatatgatagaaatggtagttaacttaaatcctgtatttaagttcataaatattcccagatataaccaagtagggtttgcaagagctagctgcacgatctactatagtagccactagcacatgtggctatttaaattaattaactaaaagtaacaattccattccttagtagtaccggccacatttcaaatgctcaaaagagacttgtggcacaaaagaggctatgctcaaaagagtctagta

SEQ ID NO: 1532 - DNA, 3400 bp, artificial
  synthetic oligo
atacaaaaattagccgggcatggtggtgggtgcctgtaatcccagctactcaggaggctgagccaggagaatcgcttgcaccctggaggccgaggttgcagtgagccgagatcgtgccactgcactccagcctaggtggcagagtgagactccgtctcaaaaaaaaaaaaaaaaaaaaaaaaaaaaactatttctgccacatatcatttttgttaataatatatttgtatttagaaaaaaatactagaaagctaaaacaccaaaagtttgacagttgcttgcagtttctcttctctgggtttatctgtatttttcactttctgaaaagaacgtgcattttcttttcaggcaatgcatgatttattttcatagtctaagaccatgttcctcaactccagcactgttgacatttggtaacatgttgttctttgttgcgggctttcctgtgtgctgtgagatgtttagcagtgtctctggcctcgtcccaccagatgccagtagcaccctcctccccaagcagtgacaaccaaaaatgtctccagacactgccaaatggctcctagggacaaaatcactcctgagattttgagaaccacaggtctaagagaacctgaaaccataaaacgtatcaatgaatgaccatgaaatgaaataagattattcaaactttgtttcagatttgcatgatatttttttcattttgaagaaaccagcgtcctgccaacatttaacctaaaaccatacttattccagaagatgaggccacgtcctcaaatgtgtaaaacagtagcaaacaagaagtgccaagatgcaggagccacgtttccccttttaaactcctttgtccacttgctacaagtttgagacctccagaagctgaagtcgggccagcctcacagggcatctatttcccattcgtcctcacactggaccaagaacaggagagaaacagaaccctctgacatgttctctatccaaggcttcctaaggaccctcattcggactgatggactgtggtttcttgtacgtacacagatgcagctgacgcaagggttttgtgatacagtattagtctgagtggagaagattccatgaacatgtcatctagtaccattctaggctctgagaggagcaccatgttcaagatacctacccttggagggtcctcccattctagtgaggaacacccacgacaaacacatgaacaaaatcattccacggagcagatgggtctagtcacggggaaaagtcacttggcggcagcagggaggggcagctttatctggtgacaccagctgagccctcagggcagagaagggggcatctatgcagagatctgggcgtcggctggtgaaagagctcggagcctggaacaagtgggagtattggaggaacagaagggagagacgatgtggccaggctacagccaacagaaggccagtgaggaggggagaagtcggggtccgatcaggtcatgccttaataggtcctggtaagaactctggcttttactctaattgcagtgggaaagcaccggtgcgcattaagcaggggagggacaagatctggtttatgcttttggaagacacccttgactgccgcatagagagtggacaggagcaggacaaggctgctacttaacctccgcaagaagcccagatgagagacatggacaagcgtggcccaactaggtgcagaggtggaggcagtgacagacgcagtcctgtttagaagaaggctctagaactgtgtgggaaagctcaggtgccgtggagcacagctgaggagtggcggtagtgtggcactcagggctttgcaaagctccagggtgtgaagcggtgactgatgacagagaccatgaatgccagggcgctggacacccattttgatttttaaataggctaatacggcatcttgtaacatccctgcgagtcaaagcccagggccccaggagttcccagctgtgtgagcaatgcagaccaggggccaaagcgcagcccagtgccaggaagagccctggatttgtctttgaccaatccctaatcagtggctgatgcctaaaacaccaccatttgagatttctttggagtttaggtctttagctgggaagaaaacgcaaattcccttcccaaaggcaaaacagaaggtggtgagggagactggacctgaagttagcagtgtgaccgtgaacttgagggcagtcagacggagaggccggtcaggacagaagattcggatttccgatttagaaacagctttcgggctgtggaactggaaataatcaggggtacattagctggtgagcctccaggaaagcaggctttgatggaatgagggaacaggactctgtggcttcgggggatctcaaaaaggaggaggcagcaattagcaccagaaagagcctccagctggcaggaagggagcttggctgcttcccaggtttcctaagcgagctccagcctggcctcgagtgtgtctggtctgcaaatcaccgggcccttgccttgtccttctgcagctgctggtgcagcccagccttgggcagagtgagacactcccttctgggatgaatcctgtggggaccctaaaggcagcttttccaggctcctctgggccatcaacccagttaattggaaaaccatgttcctgaataactaagttactgaaatagtttcaatagcttctgaaagcacaatcaaacctaattttcttactgagtttcttttttttgagacagggtctcactctgtcgcctaggctggagtgcagtggtgcaatctcagatcactacagcccgggttcaagtgatcctcccacctcagcctcccaaatagctaggactacaggtcttactttttaaaaataaacttaattttgcttatgttttagttcactattttttaaaaaaaatctcaacttgaaggcattgaaaagaacatcgttattccagtcttgatcacatttccccctacccgtccaactgtctcagcctcccaagtagctgggactacaggcgcctgccaccacgcccagctggtttttgtatttttagtagagacggggtttcaccatgttggccaggctggtctcgaactcctgacctcaggtgatctgccacctcggcctctcaaagtactcagattacaggcatgagccaccatgtccagcctcacgtttttaattcattcttcctattatgcatcaactactgtagtagaggttgaggagattgaaaaattagattatttgatttctgccccagaggatctactactggtaggaataatgtgcaaacaagtcattaaaatgcaaagaataagccctatattaagatatattcaaatcatatgtactaaattttaacttacattttaatttaccaagtaaataaattctataa

SEQ ID NO: 1533 - DNA, 8550 bp, artificial
  synthetic oligo
cagctcaaagaggcatgagaaaaagtcatcgttttaagcttctgaaattttggggtggtttggtacatagcagtagagaactgagatgggacttgggccacagcctagggcggcatgtcctctaaggatactcaaaggcatctgttacctgttccctgacgcacagggtccccaagagatgcctttaacacctctcaatccctctgcatccacagcccagattcccagcctccagctcaaaaccacaagcagacaaaaccttgaggctgccaatgtatagacaggtaactaatggctctctgtccctgtgacctgtagggaagtaagagttggttctgagctgccacatctcgctgtgacacggacatgcttccgtgacatgttatatagccccctccttcataactgttcccagtagggtggccctctcatctttttaggagttgtcaccttcagtttcacagtccaccctgtgtcttttccaagcccacccaacaatccaggcgtggaagctgttctgtcctccagacccatgcccattcccagctcctcagagctcctgggggctggctcagcctccacaatccccgccgagtgagctcagggtgctgcagagtgtagagggccaggcctccccacttcctgtccccaaggcccttgacctggcagtcacggccatgtgctgtttccaacacagcgctcctcctggccaggctgcccagctcaggagttacggattcgaagaacactaaatgctgggtgaaatcccacccaccgccaggtctgcaatgcagggtgcctcacaggtggctcctctcacctgagcggtagggaggttaagctggcactgttcacaggcactaggggtacaaagaccaacattcaggcaagaacatgaaaaggaaagggtggcctctgcccggctctctgaaaacagcaaatgtgggcagcacaatgacacccggctgggatgtcctctttaagggtgctttgccgtgacccaaaagctccttgtattggtctcctagggccactgtaacaaaataccacaaactgggtggctgaaacaacaggtgcttattgtctcacagtcctggaggctggaagtccaagatccaagcgttggtagggccagggactcctgaaacatgcagggaatccccgcctttgcctcttctagcttctcgtggtctgcgggcggtctctggcgctccttggctcctagatgcacccccctctctcctctgcctccccgaggcattcccctgggaatcgtactttgtcttctgagcatgtgtgtccaaatctccacccccaccccccaactttttgagacagggtctcacttggtcacccaggctggaatacagtagcatgatcatagctcactgcagcctccaactcctgggcccaagggatcctcctgcttcaggttcctgagtagctgggaccacaggtgtgcaccaccacatgggctaattttttcatcttttgtagacacggggtcttgctatgttgccccgggggatcttgaactcctggcctcaagtgatcctcctgcgtcggcctcccaaagtgctgggattataggggtgagccaatgcacctggctcaaatatcccccctttttaaaagacaccaggctggtccgagtgcagtggtgtttgcagctagttgatgacaaccagttagagatttctttgttccttccccactcccactgtttcacttgactagttaaaaaaaataaaaagaaagatttaaaaaagaaaaaaaaaaagtccaaaacaccagtcatactggattagggcccacattccagaacccattttcatttgattttctttgtaaagaccctatttccaaagaaggtcacattctgaggtactgggggttaggacttccatatatcatttttgggtgacacagttaaatctgtaacagtcccttcaggggaaagagagtgtcctttgtttcagacactgcccagaagtttcttgaaagttttctaaaggaatgaaggatcccagaaataacacaggggccattacttatttaataataactttctcattggcaatgaaaagtgacttcatatgccatccaaaaaagtcagtacattttcaaacccttcatacaggcggggcacggtggctctcgcctgttatcccagcactttgggacgcggaggcaggtggatcactggagtttgagaccagtctggccaacatggtgaaaccccatctctactaaaaatacaaaatagccaggcatggtggcccatgcctacaatcccagctacttgggaggctgaggcaggagaatcgcttgaacccgggaggcagaggctgcagtgagccaagattgtgccactgtactccagtctgggcgacagagtgagactctgtcaaaaaaaaaaagagagactttgtacagtgaattcgctaaacaaaaacaagaggaggcggggagccaggcatgccctgcggaggaatcgagccagtcacagccttcagctctctccctggtttcccggaagtcagcagcaggtcaaaaagcagccagccatggctctcaggtgggcctcatgttttcctcgtcaccagctgctgtttattccaacgctgccatggaagctgcaggttagatctacaacggccccaacagggtccaccgcacacggtcaaagtgctgaggacggtcattgctgtcttccagcccaggagctgagggtcctcttgggattgcaggtatcagaagactcttgtcgacttgaggtcttggcctgggctctgaacccaagcagctgataggaggtgagaagctctgagacccttctgcaggggcctcgccgggctggagagagcagccaaggcacccaagcaggcagcactcgggacccattgaacatgctgccctcacctcaaccggcagaaacctgcactcacacctccaagttccttctgcccaagagggaagcagagagcctggcacagacacaggccatgaaggcaccgtgtttggcagagaagccaggaagacgcctctggaatcgcgttctatcagggccgtgtccacacactgcggcctcatcatccataagcaatggccatttggccttttgtgaccctgctgtctcaaggcagtgccccatggaaggtcagtgctggtaatggcatcctagggctagagctctgcattagtctgttctcatgctgctatgaagaaatacctgagactgggtaatttataaagaggtttaattgattcacagttccacgcggctggggaggcctcaggacatttacatccatggcagaaggcacctcttcacagggcggcaggagagagaatgagaaccagcaaaggcggaagccccttataaaaccatcagatctcgtgagaactcactatcagaagaactggatgggggaaatcacccccatgattcaattatccccaccgggtccctcccacaacacgtggggattatgggaactacaattcaagatgagatttgggtggggacatggccaaaccacatcaagccccttacatgtttctaagcatacatgaggccagaagctgcacacccaaccttgggtacaccggggtgtcctggcatcagcttcccgtgaggtcacaaggaaggacatccctttccacaatcttggctgctcggcggtaaaacccccacccgcaatgctcaatctgcactatgttggccccagtacatgggctgcccttcctgttagctcggggagggttgttggaatgataagggatatatttacctgatagcccaactcccacctctccagaagccagtcagaaacctgtcccccaaaggcacagatcccacatggcctttgagccttacccactgtaagagcaaacatgaagggaaactaaggggctggattctccctgttgaaaataaagggaaaggaccctcccccaccctgcccagctttcttagagccttgacttgagagaacttataactttaaggttctttctctgtctctgagatatacgtgaatcttttaaacggctaaataagactcttgccagaaatgtcttttgcaaggacctggaagccatctctctgaaatgtaatcatcaaagaagatagggcctctatctcctagtttcctttttcttttttttttttaaacctgtcatcttttattaatgttttcataactctgctctcccagaaataggaaggtaggtttctaactttgatggtggcttcactccaaaactacctactgtcttaaagatatgagaagtttagtgtttttccttttttttttttttttttttttttttgaggtagtgtcttgctgtcacccaggcgggactgcagtggtgcaatctcggctcactgcaacctctgcctcctggattcaagcgattctcctgtttcagtctcccgagtagctgggattacaggcatgcgccaccacgtccagctgatttttgtatcagagacgaggttttgccatgttgcccaggatggtgtctaactcctgacctcaggtgatccacccatctcggcctcccaaattgctgggattacaggcgtgagccaccgcgcccggcctatattttcctttggatgaagccaaacagtgaacaccaatggtccccccaatcaccaggtgaatctaagatgagctccttgtgacaaatggcaccaccaagttgtcttacttgaggactagttacggtttctcttgagaacacagatgtcacgggttgtgtctgctcggctctatgaaacagtgagattgctttccatctttgcagtctcagtggattgcctgtgatgcacctcgcattctggtttaatgcttatccaataataaaactgtttccttctctcctacctttgtggagaggttttctggattgggaggagactttgtttttaattctacttcccaaccacgcccaacctcaatcacgaagcatgacttactttgaacatggctgcctgcggctcaccaagctcatggaacggaggcttgctggtggccatctcaatgatggtgcagcccagggaccagatatcggctggggcaccatatccgcgaggcccttggtcaattatctcaggtgccatgtactgcagggtgcctatttggaaaacaaacaaacaggctgtgggtaccatattgctcagaaactaagtggcctgtagtcccagctactcgggaggctgaggcaggaggatcacctgagcccaggtgttggagaccagcctggacaatgtaacaagaccttgtctcaaaaacaaaacaaaacaaaaaacccaccactaactgtgaaatgaatggcttcacaaatggcagatggagtcttgtcccatgcataaataatatggttgcttcttttttttttttgagacagagtcttgctctgtcgcccaggctggagtgcagtggcgtgatctcggctcaccgcgaactccgcctcccgggttcaagcgattctcacgccatagccacccaagtagttgggattagaggcacacaccaccatgcccggctaatttttgtatttttagtagagacgaggttttaccatgtgggccaggctggtctctctgacctcaggtgatgtgcctgcctcagcttcccaaagtgctgggattataggcgtgagccactgctcctggcctgactgcatatttctttgagcagaggcatgcaacatgccttcctttaatactaaccacgtggagagaggactgcctggcccatcaaaggacaaatggcgcaattcagtcagcacatattagtacatgccaaatacagggaagccagaacgtgagaaacacagcctgatggtagggaggtgcctagtggaggagacaaagacagaatgctggcagcggtggcagtaatggcaaaatgtggtaggtgctaggacagagaaatacacagaaggctgcaagagcattaataaaatagggtttgactctctgcctggttcgggtcaggaaacactatggctgtgtccatttgggcctctgaggagtaaaatgccaagacgagatgagacatatgagagatttattggggagaaggtctctgaaggacaaagcgggagggagcagggtgggcagggccggctgcggaccacatggcaggtgcaacacctgggagcggagaggaaggcagaatcaggaagaatctgggatgggagagcagcccggagagggcttcagccaggctgctggggagtctgcagccccaagtcatccactggaggagtcccacctgggttctagcacccctgccaggctcaggccttggtggggagcagcctgggtaaagtgtaactttgctgggttggtagccggggctgtcagggaagcagggtcctgctgcgaaggctggagggctggacaaaggggatcatgggtgtgagatagacagcggtccggggaacaagcgatgtctgacacggggcagggtgtgggaatagttaaggaggcaatggcaagggcacaggcccagtggcaagcagggtgggcccagggctctggctttggacgtgctcttgtgggagacagcacacggggaggtcagtcaagggctctgcgaataacatccttcgttttccttgaaactcagcctgtgcaaaggggacgtgtgtgaaagtgacagcagctcctgggggctggcaaagaaatttagaaaaagacagcaaagtcagagctctgaccttggccacgcatgaatagaacactgaaacccagagaaattcaaaggcctatctgaggattacacaactaaaggtttaatcaatgaaagcagggccgggcatggtggctaacgcctgtaatcccagcactttgggaggccgaggcaggcggatcacctgaggtcagaagttcgagaccagcctggccaacatggcgaaaccccgtctctactaaaaatataaaaatgcaaaaattagccagacatggtggtgggtgcctgtaatcccagctactcgggaggctgaggcaggagaatcccttgaacctggctcgcagtgagctgagatcgcattactgcactccagccttggcgacagagcgagactcagtctccaaaaaaaaaaaaaaaaaaaaaaaggaaagcaaagggcgcactggctataaagaaagtttggagaaactacctcctgtgtccccctctggaagatcctatgtcttattagcattctttaaatactctaggggcagctgtgacggatggaatgtcctgcgctgatggcaacgttctatcctgtgtggttaaatatggtagtcactagcctcatatatttgactgttgggcccttgaaatgtagctagtgagactgaagaaatgcatttttaagttttaattgtattcaattacaagtgacttaaatataaacttaaatatgaattgggttgtatcagtgagcacaacagatcgatgaggaacaaatgatggctttggtctccagagctgatgccctggcggggaaatgttcagtgagttgcagagttgggcaacatggcagcgcattacacttgatgccctgttaggaaatcccagagccccaagaagggaacatccgatgacacaatatcccctatgggctcttgctgctgtaacagagggagaggtcttggcagggaatgtgccttctaacgaatccctaattgaggaaggatccgatactgtgctgcttatgaagctaccctctctcagctctgctctgtgatgctgagtctgggactctgcttcgcctgcagctccccattaggctccgcaaccaggtggcgctaaagagagaccctggaaggatgcgggaggaagcggagacctgctgtgtgcttgctgtggccctaagcttggcgttggaccctcagtcggccccagtctcccgctgtgtgtcaccccgtacttccagaaccagcctcatcttgcccctcagaggtacctgctccagcctggtgacactccctccgaacaagttctaatctcaccctcccatttgacccccaagccccaggggtacaggcttcctgatacctcagggcctccctttctgcctttctggtttttggtaaccagcaaacagttatttctattaaattctctccatggaaataactggggttatttttgtttttctgcctggaccctgactaatataatcactaaatttatttcttcaaagagcaagagaatacatttatagatgtatccagcagtagaaaagaaacgctaaaccaaacatcaatggctaattggctctggtcaaataactgtccatcctggtacaattatttcctaattgaagcctatttagtctgcttaattctaaatttggagattttgcacagcaaaggcaacagtcagcaaagtgaagagacaacccacagaatgggagaaaatatttgcaaaatacccctctgccaggagattagtcaccagaatatataaggagctcacacaactctataagaaaacatctaataattagatttttaaaaatgggcaaaacatctgaata

SEQ ID NO: 1534 - DNA, 1650 bp, artificial
  synthetic oligo
aacacaacaaaagttttcttttaaaatatgatcctctgcaatccacgtgcctctgaagtgtagttcttccattttctcaatctataatacacaaaacaaaagcacatcaccctggccgggcgcggtggctcatgcctgtaatcccagcactttgggaggccaaggcgggcagatcacttgaggtcaggagttcgagaccaacctgaccaacatggtgaaaccccgtctctactaaaaatacaaaaaaatcagctgggcatggtgtaatcccagctacaggttgagccatgagaattgcttgaacctgggaggcagaggttgcagtgagccaagatcatgccactgcactccagcctgggcaatagagcgagactccgtttcaaaaaaaaaaaaaaaaaaaagatcacccctattacaagagaatgacaggttttgtggtaacacaatgcttttgcccttaactcctccacaccatgagcggtgggtatgggatctggggtgtggagacggcacccgaaatgcggaaggcccgcctggacttgcctgctatctctctccgggatttctttgatggctattcgcacttgattgctcagatctcggccagcatacacaatcccatacgtgcctttccccaagacaactctctcaccatttgcatcatggtcatactcatactgaagaaggaaaaacaaaaggacaaaaaagcatacaacttgtagcggagaagccctctaaggcccccagagttgtctagcaactaaaaaaaatataaataacattatttgactgtcaggcaagtcacagtgcttagcttaggcccttttcattaaatgactttaaaggggcagaattctccattgttcacctgttcatagtatgactttatgaaatggaatccaagaaaattaaaaatatggtttgcatataattggctcaccttttggaaattcttccccattttaacgctgcaatttaaaactgcttctaagcatgttgaataacccaactaggtgtcttcctgcataatcccttatcaagttgtcaggaaacaaatatctttcaataacccagaaaggaattgaaggtcaatataattaacattatcttaatacaaaaagtaaatatgctggggcttccccactctttcaggcatacggatctagtagtaaacacctagtacaaaaacttgatttacaattagcattactattttgttcccccatcttcccatcaaaagctgtcacatacagatgcatttgattcttctcgatgattaaaacaaatgtgactgtacgctgagcaacacttatttaaagcagagaggcagcaatcaattttttctgttattttgcatgctccactgcttctacttacagaagtgcagcttatacacggaatagtcggcgggtatgtgggtgtcctttcccatctacttctagggatgttcatgacaattaagattactaaagggttggctggacactgtggctcatgcttgtaatcctagcactttgggaggcccaggcaggaggaccacctgagaccagcatggccaacatagcgaaaccccatctctactaaaaatacaaaaattaggccaggcgtggtggctcatgcctgtaatcccagcactttgggaggccgagg

SEQ ID NO: 1535 - DNA, 1250 bp, artificial
  synthetic oligo
ctgctggggagagagcaggtgcatttccacagagaccatgaagctttctcccaaaaaggaatcagaatcctaccactgtttgccgatgtctactacaagcacatgctatatacccgagaaatgtatccatatgtgtagaaaaagcatgtacagcaatgtccatagcagcgctgttctcagtatccccaaaccgcaaacaacctagaggcccatcagcagtaaaacagatgattgtggcatacctataccaaggactacgcgacggcaatgagaacgaacaaaccactaatacacacaaccgcatagatgaatctcgcgaacacgacgatgaatgacacaaaagagtacacactgtgtgattccgtttatgtgaagtcaaggacaagccaaactcatctatggagacagaggctgtaacagtggtcacctatggaggggttaaggattgcctgcaaaggagcacaagggaacttctggggtgatggaaatgttttcttttttgatgggagtgttgtttccatgtgtatagccaattatcaaacacaaatcatatacttaagatctgtgcatttcactgactgcaaattttaccgatttaaaaaagagatgtgacctcgtatgtgttacaagatatgtgaagccgggggtgcctgttttgatgccgtcataagctattaggatggattgatgtgttcaatctcacagctagaatgtgtatgccaaatacaaagtccctgaggacaaagactggaccttgtccatcttcataaccttggcatttagcacgtgacctggctcatacccgatgttgaatgaaagaaggaagcacaattcaatgggtggcatgtttcaaaacctgtacgtacattatcgttcttacctattcagtgcaaacgcatagtggaatttaatgttatgctgatcggccaaatcacacgtaggcagcatctccagtgtttccaccagcttcaccatcgcatcatagtcctgttggcaagaggtcccaaagtgagcaagagaggaaacacagctcttcactgatttttctgaattgttataaacaggagacagcctccgcacttaaagacaggcccttccttacaaagggcatttagtgaagttacttgtagcctttaataggagggaaaaagaccagaaaataagatggatgagagagagaagaacagagaaggaatccctgctatcaaagggcatgaagcatccaaaggcaacaaaagtaaatgaggcca

SEQ ID NO: 1536 - DNA, 1450 bp, artificial
  synthetic oligo
gaacaggcacacagacacgaggcactaggaaatggtgcacattttgattctcaggctgccaggctgcaaagtttgtcaaaagcagcaataattccagtttcttagccagagggtagagcaggcggtcctaacaggcggggccatctggcagtgttggaaggcagctgtggttggctcaagggggtgtctgtcagcacccccaaaatgatggcaagcagctacctatcctttgttaagcagcatgggtccccatcaccacaagggcgccaactggatgaaagctgaaagtctaccttcggtcaatcagaactcccacgcattctctgccatttggtaacagcagtgttgaatcagaggctacaggggacagagctctaacgccctggcaggacagaaatggccatcactgagaaatcaagagcaaatgcccccgaacatggacagctgtggcccctggagccatagtgaccacatataatgaggcctcttggaaatggaggtgggagaggggcttttcgcagagatgtttaagataaattccaggctgggtgccgtggctcacacctgtaatcccagcactttgggaggctgaggcaggaggatcacctgaggtcaggagatcgagaccatcctggctaacacagtgaaaccccgtctctactaaaaatacaaaaaattagccaggtgtggtggcacatgcctgtagtcccagctaatcgggagtctgaggcaggagaatcgcttgaacccgggaggcggaggttgcagtgagccaagatggcgccagtgcactccagcctgggtcacagagcgagactccgtctcaaaaagaaaaaaaaaaaaaaaaagataaattccaaatgagaaacccaatttggggcacatttcctaatgtttcccttccccaagacttcctggggaaacgatatgtagtaagcccatacgattctaagaagatggtcacaggaaatgtatccagatctgcagagaggtgacaatcatttatttttgaaataaaagccctcacaatgtcctgccccactgagcctaggactcacgggcagcagaacccaaagggacgcacctgcaaccgaagccggattttcttctcttcatccaactcagacaataactgtttaatctctcgtctgaaaagcaaatggcaatgaaattaaccaaaatcccagacttccttcatcagagatcagaaatctcttattatgactacaaaatccatctgatccttttttacaaagaaactgtggacaacacatcattattttctttgcattgttactgcttaaaatttgtttcagacagtaaggctcaccattattctggggcccctaaaatatgtagccagcaactggtgggtgcggaagtgacctctgaaatcccttagtccaaacttctctcaaaaggataagatggggaaacagaggcccagcgt

SEQ ID NO: 1537 - DNA, 1050 bp, artificial
  synthetic oligo
tttgtgtgctgcgtctttgtcctggttagtcaaactctccgttaacaccactgtccccgcctctctccacacactccattcacttgttccttcatccacaagccaccaagggcctgcttggtacaggcatttcccccttactcacacgccgccttctatgtattttaaatgtgaccttctttctggacagagagtttccgactggttcaatatacacattgagatgcccaactacttgccaggcaccacaaactctgaagtgaacaagacatgccttaataggcattctcctggtctccagggagctcagaacccagtggggcgcagacagacagacagaccaacgcactgagatggggggacaactgcacagagggaggtgagcatacagagccccagaaacacagaaaaggggccagccatccagacgggcaggcatcgcaagcaggtgctgacagtcccgtcttggaggaggaccaagaagtagccagaggaaaggaggggcacttagagaaagaagctgcagcgggagggaacacgccaggcaaaggtctagagaccgcagagcaaaatgcattggtgggaagtactgctagaccgtcagagggggcaagagagggccttgggggcagagctaaggctgggaagtacaagcggctaggcgaaagggtgagaggagggcacacggtgctgaggaccatgctggctgcagaaaggctaaagggttggcagatctggagctggagagaactgctgggagagtcttacacaacgtaagctagaagcggtcagggttggacccaggcagtggctaggaggatagacacaagacaactttgagtgatgtggcgaaggcaagcacagccgacatagagcaccaggcattgttcccagtgctgggggcaggagtgggccaggaggatggagaccctgccctcatggaacagacgccttgtgagcagggagatgtggtcctggacaggatgcagagggtggaggaggaaggacagatcagggaccacgggtgtggtgcacacaccaggcatcgag

SEQ ID NO: 1538 - DNA, 1100 bp, artificial
  synthetic oligo
gaaataaggcccaggacagggaggtttgttgggggccgggcggggtgctggttggggaggacagaggcataacgaggggcagaggaaggctcgggaagaggagagaggacaaaaacccaaggagcagatgctgactggcagccagtgaaggagatggaagagggggctgttaaagtttccagcaaacagacagctgccaacggccttggctggtagctaccaggggcagagctggacaaacctatattatggctctgtccaggaaactaaaacaagctcaggagcaaaaactgaacaggatgaagtgactaaagaacaacgaaaggctaattaacactgcttctccaactcagctgcacggaggaatcacctggacaatttaaaaaaacaaaacaccactgcatcccaggaactgactcaccccatctagggtgcatcctgggcacaagcagatgtcaatctccccaggggatgtgaacatgcggcaaaagctgagaagcactgctctagaggaggctgggggctgaggggagggaagggagtgaggatttggccaagcggaggagtggagaggccaccaagtgactgaagggtgttccagggcccagtgaatagagagcctgcctgggctctctaacagtgggtcctcccatgctgggctgaggagtgctggcccgatttggagggccacagaggtgctggagcacttgacgaaaatggtggccaaaggctcgaatgattggtgacaggtcagacacactgcagctggagccaggaagaggcccgagatgtgacccagcataacagtggggtgggagaggaatgcagagagccaggggaggggatgggacagctttgggcccctcttaggatggacttggtaagtccacttgtgtgcaggggtggacaagttaacaccaggaaacttctgccaggactccagggaggattccatctttgccatcccccgaccctcctgggcccactgaattaagtccacctggcagtttaggatttcagaatgtgtgaggtggcagtctgtaatgagttatacttttaaaacaacccagaagtgtgatgtctgtctcccgcacttaggc

SEQ ID NO: 1539 - DNA, 1050 bp, artificial
  synthetic oligo
agcagcaagcaggagaggagaggcaggaggaagagaagatacactctggcaccaaccaactaaaggaccatgggttcttcaccagcaaccatgtaccatgcatgctgtaaggccccatgaaggagaagcttgggacatgggctctgccttcaaagactacaggctgtaagtacagctggagaagggagagggaataccatctgggtggctttgagaaagtccactggggctgagtcaataggccatactcagatgacattaactccttgacaaaccccatttctttgcatgtgaaaccacccatgaaactaaatgttcaagacagataatgtttaggtaaatttttttcataaggctgcttattagaagcacatatttctttcttttggaaggctaaaaaatagggaaattatcgggcatcttcagaaactagaaaaacaacagttcttgttatagatgccacgttttcaaacaagatgtcttttaagatgattctaaataaaaattagggccagggctaaaggctaaaggacatgatgaataataaagaaaatgttgactaagaacagattttacggactgagttgtcagaagatggaggctaagtaaggtgaggggcctcctacgaatttggtatagggaaggtagagttaaaccagcaaaattcggccattgtgggaatcgagcaagagacttcctttcttgcaaaagtttggaacctgcaaaacttgtgctaaaaaaaatcgtaagagggtgggttggcacatgattataatggagaaagtgggaaatctaactgattgcatcacaatgtgtctggagattgatgtgaacaggaagggtccagtcagtcatgaaaacaaagacaaatggaggccgaaggcagtggtgcagtgctcttagaagtatcatcaaggcttagttgacttcaacacatggttcccttggcagatctttccctttggtgcatgaaggagcctcaagtgatacctgccagacccttggtaagaacaacaaactcctcttgttttgattccttgccctcccgga

SEQ ID NO: 1540 - DNA, 1100 bp, artificial
  synthetic oligo
cggaaatcttaaaagctgtttctaatggcaccttcagctcatccatagcacattgctgaatatatagtctactcctccaggatgagcatcctatagctgagtttttaccttcatttatggtttagagaactgcattgactctgcatccaaatacatgcttttcttccattaaaaggatggtagctatgagagaaaatcattttgcttcacaggtagacagtagcgttcataaagcattttttattattatgttttaagagattttcttagctcctgcaccaattctaagagatacaaagaaagctttaaaaaaggagaaggtggtattcttcattccacagataaggactgggaaggaacaggaggtgaagggcatagacatgatcattttgaaggtcaagaacattgaagccagctgcagcgactattagtaaattcctatcttccacttccattcttcaccagacaaatccacacttcttttaagaaattcttctactaggaaaacatatttcttagcctgaaaacttgtttggtggcttttaatctatacttagctgatttagcttctaggcctgtgcagcgagtaaaaaatacaattccaaagtcaaatccaggccctcgggctgctcagctgagtccagaacagaccactggagtatggctctgtctgtctgccaccacaggggagaaagggcacggggcaaggaaaggctccaatgtgaaagatccatgaattacaagaggtattcccaggaagactcagaatgaaaccaaggtccttcaaatccacgcaattacgtagcaggcaattacttactgaacactggggcttagatggccttgtaggaaaaatagactagccaataacattctctcaagagtgtctttgcagagcaaaagtttttaattttgctgaagttcaatttggcaagttttttcttttatggattgtgtttttggtatcatgtctaacaactcttttctccagtgtttcatacataacttttgatgttttatgttttacatgtagatctatggtccattttgagttaaatttgtataataggttcaggttggttttttttttttttttctgc

SEQ ID NO: 1541 - DNA, 1550 bp, artificial
  synthetic oligo
tcaaggcatgttacgatattcgctccctttcatttctatgcacaccccattatgatgaattacatatggcatgtccaccaagacagctttacagaacccatacattatgaaagcaaagttgctttagcttgcttttgcatggagatgcatctgtatcttttgccaagaattaagcattttagttcagtatactagaacaattttctctaaaagtcaacactcaccatgagaggtagatattccttattttacagagacgttctttaacctctaggggcttggtgctgtaatcacaaattccttttccttcctccttttgccgccctccatttcagtaaaattggtctcaattactatgaccacaaattctcacaccctaatgtttctgtactcaactacggggccttgccctttcctcctcctcctcctccatgttcacattttacgaggcacattctcagtcagccctccttttgtgctaatttctgaggccattacagaggccatattccactccttcggcaattcttagatctcaaacaaataccagccagaccccatcactggaaaggcaagctacggacctccaaaaagagtctgcctatggagtaagctgtttgtgcgtaattcacaacaaactgaggggctatcagtttctgttgtacttcatgcctctgtcttgattcaaagaagcttaaatcaatggtgtgtgttttgatctcgtgctaattatgcagatgtgtttagtttgtaaaaattcaacagccgtaccctcatgcgcattttatgtatgtctattatattgccataaaaattctttttaatagcttacaccatgtaaacctctatataaactaagcatagtttacacctcacctacactaatgtccctcaaactgttttcaaatggactgccaccaatcggtgggccacgtaatcagtttagaaggtcctgacaagcatctgttgaatggaatggagaatacaagagggcatcacacacagtgaaggcagctactgtttcaggaaacttacctcagttacatgggatgtgtaccgtagaccaggttgccagatgtttttttaactgcagaacttggttgatatagccctgggagacactgagtacatcaacaaataaaagatgaatttgggagtcagacaagcctggtttctgatcttggctggttgcaacctatgtgcttaggaacaagtcacctaacctcagtgagcctccattttgctatctctaaaatggtggtaaaaactgtcaactccctggaattggtgtaaggtgtcagtgagctggcaaacagtctgccacagagtgctacttagacatggtccctacccccactgccatttaggtggtgccttgggctagcttctttacctgtaggaaggaagtttcaaggaaatatacaaagaaaggaagtgccaaggtcgagacctcactaacatctgagagcatcagggcaggggaaagctattatcccagcacatttggtggtaagtcatctggctttgtattccaaccagagggaaaacca

SEQ ID NO: 1542 - DNA, 1500 bp, artificial
  synthetic oligo
gtggaaaacagtgttggtcaccatcttggaaggactggcctgagaccaaattccccatcatgcctccctcctggcctacaaagtagtcgggcaacaggctacaaaagatgcagacatcgcaacaatcaaaacagatgtatggcctacttacaatctcagacaagtctgcggcacttggggctttggctgctgaaacctccattctgtgaagtatgaaatggtaatttctggctgtgtctgaactctgggcaggaataagttccgtgctctccgagaactgcaagtctctctgattcacttggcagcaaaattattctaagcatcctgtcccgtacccaacccgcctgcccctcccactacacactcacactggtggtttttttgtaattctttgcacttatttctgtcgcaaatcaagtgaaaagtaatccaatctctggcacttgagagtgtggaacctgtatgactgaggaggaggaagagccacctaattaggaagaagttataattaacatcagagaggagagagctggagaaccgcagagtctgcagtaacagcaaaatggagattatttgagacagctgaaacactccacccaggcctccagaagaggacatgcacgggaaacaaagggcatatggtgtttgctttcttcaacatccgttctcaccattacgagctgcaccagcaaacgttcattacttacatgtggacaaacctcgccctgaaatgcactctaaaatacagctcctaatcaaataaatgacttcgcaaagcagaggcttaccttgattttttattacatataagtaataaagtaaaatttaataaagtccaaataactggcagaatgtctatttggctcagtgaagcatgaattatacttgaaagtccatttttgttaatttcaggttcatacagtaattcaaatactgacatagtcagagcaggattttattttttccccaaggagagattccaagggactaagttaataactagataggaatgattttctactatttacttctagtcgtatatttagatatttctatcctaaagcaaacaggtttttcgaatgttactcaaatcatttatttcccacatatgttagtgttaccaccatcaccaatattaccctcactataaaactgttcaaaggtaaacttcagcgaacttcttgaccaaattatcagaacctcctgaattagtgagatctgaattgatacttttcagagatgtaaagttagggtcagcttcaaaaatactcacatattattactctcaagcctattgagatcaacgatcaaatccgctgtcactcagccaggatgaactgggattggtctgccttcccccagataacaagttcaaaatcagaggatcaccttgcttgcatttaacataaaaaaggcccccaagtgaaaggaaacaaacaatccaatgcagttggtcaggaaccctcagtgagcactgctggttgcctacccagtagagct

SEQ ID NO: 1543 - DNA, 1150 bp, artificial
  synthetic oligo
gaggaatgagaatgagcaggagcattgtcatggtgaagaactctctggtgaactgttcctggatgttcttctgctcatgctctgactttctcaaaacactgtcataataaacagattttattgttctttggccctccaagaagtcaacaagcaacatgcctggagcatccccaaaaactgttgccctgacctttgctcttgaccgcttttgctttgactggaccacttccgcctcttggtagccactgctctgattgtgctttgtcttcaggatggcactgggaaagccgtgtttcatctcctgttacagttcttccaataaattcttcatgatcttgatctcacctgtttagaatttccactggaagctccgctcttgtttgcacctgatctgggagcaatggttttgccacccattgaatttgctcggttttaatttttcagtcagaattgtgtgagctgaaccaattgagatgtctgtggtgttggctattgtttctgttgttaattgtcagtcctcttctattagggcataaacaagataaattttttcctcgaaaattgatatggatagtctgccgctgcagaccttatcttcaacattgttttgtcctttcttaaaatgagctatctatttgtaaactgctaatttctttggaatattgtccccataaattttgtgtaaagcatcagttatttcaccattcttccactcaagcttcactataagtttggtgtttgttcttgcttcaattttagcagaattcatgttgctctgataggggctctttccaaactggtgtcttatctttcttagtgcctcaaactagatactattcagacatgttacagccaagttagtgtgagtttattttggtgcaaaaaaaaaaaaatttaaatccatgaatagttttttcataatacccattttccatgaacttgttgaagtctcctcatatagctctgtattacttggctttgatccttatcctaaaagaggtcagctcacaattgaagtatccaaatgaaaaacaagcactccagggatggtggatcagcatttgaaagactaatcagagtccatttgcaccagagttggttaattagcatgatgaaaacaagcagtggccctctgctctaggaattgggt

SEQ ID NO: 1544 - DNA, 3450 bp, artificial
  synthetic oligo
cacactgaccaaaggagacagccaacaccccagttgacccaacaggcttccaaagggacccaccttcatgctgcaatctcttagccattagcaacagttcaaatattaagccagatgacggaggagtttccactaccaatttatgacattgaagactttgtgtttttgacaggagggcattttctaagcaattactccctagggaggaagaaaagaatcctgaagcaaaacaccagggactggttcaagctaacataaagcaagaggaaaaaagaagaaaaacatcccgcattgcagggggccagagacacttccctaaaatgcaggatgagagccctgctgcagaaatgagcactctggctcccttacctcaaatctactgtgcccaacccagggcacccaaatgtgcctctttactcacccaggaggaagtgtggcaagcctgaaagctgaccacaactaaggaagataaaggagaagatttcttctatggtagaaccatggcagggaaactttggaggggacagtaaaacaagctagcccctcagctaccctgaagacagggcacgcgctttacaaggggctgatcatataaatgggtcttttcttggcaagttcaatgcaaaagaaacttctgagggctggatgcggtggctcatgcctgtaattgcagcactttgggaggccgagatgccaggagtttgagaccagcctgggcaacataacgagacctccatccctacaaaaaaattaaaatattaggcaggtatggtggtgcacacctgtggtcccagctactcgggaggctgaggcaggaagatcgcttgagcccaggagtttgagggtacaatgagccatgatcacaccactgcactctagcctgcgcaacagagcgagaccctgtctctttaaaaaaaaaaaaagaaaagaaaaaaaagaaatttctgttaacggctaatcaaaggccacaggaagattctcatacatacagcagaagtggtctaggcacaaatgctgttgtgttgccaaaattctcccatggatggcgtcactgatgattttacctatattttaggcctcttgagagaaatactatccaaacgtaaacagaccttacaacacgacaaggccaagagcagggaaaactgagtagtgctggctttctcggtcgcctcaaccatagccaacatgcactcgagcagaagtcaatatgcgatcccattaaatttctgaactggttggggaaaatgaggctctggctttaaagtcacatgttgttttcactctttcaacaaaatttttctttcgctgcctgttggtgagacactgtgccaggcatagtgataccggcatagacaagaagacctgagaaggctgtggtcttggcctgggcgccagggaaactagtgctcacagagcataatttttggagtccttgcaggaacccactggggcttcctgaaccagcatgtgccttctcctcaagtggtgacccttctcctgtgcttcaggaagcagccaagttaggggtggggagggaggaaagggaagagggaattatgtctggctacaacaaatcggatttccttgcattttccagcagaccaagtaaaacaaagataaataagatgtctcacgaacccccctcaaaaataaataactcatccccaattggtggtgtcttcctgtttataaaccccaggaaagtgaaattgcaactgcagtgtgtatgaattattttagtcagacatgcgattctcttccacctcctaagcaagaatttgtcagctccaggctaagagccaagatttctcaagacagggcctaggacaacatggagggaaggaaggaagggtccaagcacagtcttagtgaagcccagggaggcaatgaaaaggggccgaggatggtgctgctggatccaggaaaggacaaatgagtcttgctggcccctgcagactcctaagttatcaccacagaaagtttgtcctatcttatatacaaaaatgagtgcacataaatttgacaaattagcgacttaacctcccccattatcagaagaaagtgactgatgaaagaaaaaaaaattgatgaaagaaaaaagaaaaagacttctaaatcgagctgcctaaaggagtagggacctgtaatgacttcccaaagaccccatctccaaataacacaacatgagggattagggctgcaacacaggaatgaataggagggggatgcaaacgtccagtccacagcaagctggagggccagagggtattaggaaaggagggtttgatttgtctacctactatgtgcatgcaatgtatgatgaggtgattattgcacacaaggcggctctggccacgatgtgctagtgtgggcttttgttattgtttatttgtaacacatctgggcccctactgtgcgccgggatcttaatacgcaccttgtcatttaatcctagggatgctagctgctctgttagcttcgctgaggaagctacaagtacaacagtggatgggaatgccctccgcaaaaggactgtggcaaacagaagactgatggatgaaattgtcactcatgagaaagacctcaaaaatatgctttgttttttaggattacttcaacatttgaatcccgacaatcacaaagtatcagaaaacaaagtcctctcttcagcaaattcaccagttctgacaacttaacacttaaaatatatccacagccatgtgattggcaaaaatgcgatggtatgatatggcagaaactgatcattctctctagtacccattatccccttcctcttttaaaaaatacagatgcttctcaactaaccacagggctacatctgcataaacccatcgtgagttgaaaatatcctaagttgtaaatgcacttttgacttaggatattttcaactcacgatgggtttatggggacatgatgaggaatgtgctgaatgcatgtcatttttccaccactgtaaaatcagaaaaccattcaatcaacccattataagtcagggactgtctgtagaacccatcccttcccctacggtagacagaataatgctccccaatccccacaaagtatgtccatgccctaattccccgaacctgtgaatatgccacctaaagtggctaaagggacttcacagatttgattaaggatcttgacatgaggacagtatcctggattaactggctgatcccagtgtaatcacacggatctttaaaagatggaagagccggaaaaggaaatgagatgaagggaggaggggtcagggtgatgtgaggaagaggccagaagccaaggcatgcagttgacctctagaagctgcaaaaggtaaggaaaggaatcctcccctagagcctccagaaggcactcagccctgcccacccattctggacttctgatttcacaaactagaatacaataaattatgctgtttgcagc

SEQ ID NO: 1545 - DNA, 1100 bp, artificial
  synthetic oligo
tggaggttgcagtgagctgagatcgcgccattgcactccagcctggacaacaagagtgaaacttcatctcaaaaaaaaaaaaaaaaaaaaagaaagaaagaaagaaagaaagaaaaagaatggcaaaaagcgggagagaaaacaaaggaaccaaacccccaaggatttcacctttcactgtgtatcctctaatcttacacctgaactcgagaccaggattaattgccccacagtggtgcagtgaaatagggacagtgctgtggaacataaaagcccacatgcagttgcttttagaagtatcagttggggccgggtgcggtagctcacgcctgtaatcccagtactttgggaggccgaggcgggcggatcacgaggtcaggagatagagaccatcctggctaacacggtgaaacctcatctctgctaaaaaaaaaatacaaaaaattagctggacatggtggcgggcgcctgtagtcccagctactcgggaggctgaggcaggagaatggcgtgaacccgggaggcggagcttgcagtgagccgagatcgcaccactgcactccagcctgggcgacagagcaagactgtctcaaaaaaaagaagtatcagttgatctgtctccatctctcttctctctctctctctctctctcacacacacacacacacacacacacacacacagagcacatataaaagggatgataagccatatgaacacagagtttctagaactaaaactgaaagcaaacacatggaggacaagtaccctgccaattcccatgtgccaattcccttggactgaactcttcttccttctcatcatcaggggccagtccagtcatttgggcatctatggagataaagaatggatataaaatgccacactgcctacagtgtgatttccttacaggatagaaaggggacatatgtccatcacatcctcgtctatataatatcaagatcatagaagctacctaaatgctcaaatgacagggaaatagttacataaattaagatgcatgaactcaaatattcagctactaaaaacactggcttcaaagatgactatgaagtggaaaaaacaaggacatatatata

SEQ ID NO: 1546 - DNA, 1550 bp, artificial
  synthetic oligo
aaagtgggaagactgttcctgagttcaaaacccagatgggttaaggccgggcgtggtggctcacgcctgtaatcctagcgctttgggaggctgaggtagacagatcacctgaggtcgggagttccagaccagcctggccaacatggtgaaaccccatctccactaaaaatacaaaaaaattagctgggcatagtggcagatgcctgtaatcccagctactcgggaggccgaggcaggagaatcgcttgaacccgggagacacaggttgcagtgagcggagatcacaccactgcactccaggctgggcaacagagtgagactctgtcaagaaaacaaaaacaaacaaacaaaaaaaacacctagatgggttaagatccaggacaaagtttctgtcaattaataacccagatcagctgagcctcaggacaatagagcagtctcctggagaacttttccgaagtccacctatccctccatcaaaactagatggaaggactaggcatagcgttccaatgcacatctccgggggggagaaaatccccagctagacagaagttcacccatcatcaattaatcaggacgttaaaaaaggaggggaaaataacagaaatgcctctgtgttggtatacatatgaaagctccctggaagaaaacttgagaaacaaaatagcagcagcctatggggagggtcactgcatagctgaaggacagagatgggagggagactttttcccgtaaacactttttcaccttttgaatttcgaatcctggggatatataacctattccaaaaactaactttaaaaatgtctcaagcaagcagctgtagtcattatgccccagaaaacagatgaagacagtgtgaactgcttccccctttccaattttttcttcaattggtgaaatcttccacctcacttttccccccacaatccaccctccgcaagccaattactttcatttgtttcctgacagccaaaagcagcaattaagctttaaaaaaatcaccatcaattaacaaacacttactctgtccatcctgcttcatggatcacagatgagctcattgacctactgtatttgagttgacacctctctttgccatctaatagtttgttgagaacaaaggggtaattagaaatcactggctaagtggtttaaaactgtcccatttcggtcaagttgtgaagagatgtttttgctggttttgttttgatgatcaaaacaggagaaaggcaaagttcatttacgaagtcacttctgtcaagtgaatttgagaagctattatgtaaaatgctcatcaaaagacagcacccagaacaccctggtgaagaaaattgaggtccatgaagatgctggctaagaggagggggcagcagagcaagaatggcctttcccagtcttcatccaaaatgagggccaagcgtctccgtctagctccaggcacaaacctaagaactagctggaataattagacaggacactaagctaattaaagacttttcacatggggaggtaacatgtgatggctaaaactggtgcagccccag

SEQ ID NO: 1547 - DNA, 2900 bp, artificial
  synthetic oligo
agtctaccgccaatacaataaatacattgccaaaggctatccaaactttgttgttactctggaattaaacagaaatcatttgtgggcttgcaaacccttcactactcacagatttgggtcaccataatatctgtttaattgtaattataagaggctttctctgtgtctggcactgtaggcatgcatctcctagcaagttcagagggcacattctgatgggcttttataagaggccatgttgcaactaaccagcttcacttcagggttagggatttggttcttttctgttatttttcagaaaacgaaatataagatacagttttactatgttatccatcaagagaaaactcattatcaggccaggtaagaatataagtgtatcagaatcaggcacagtggtgtgagcgtgcagtcccagctacttgggaagatctggagtccaggagttcaaatccatcctgggcaacacagcgagaccctccctcttaaaaaagaataaaattgcatcaaattgataaactggataaatctgaaaaccagagacttgggggaaagggtgggcctctgtctgcatacacacaacctcagcccattagatcactccattggaagacatacagaatgaaccgttaaataactgcacttcattacaaatatactgctggagatgctttcaaaagagcaggtgatttttagccacaaactactataagcaccttaaatcccactataaacatgaattaaattacattcgttttgacattatcacctctaagtattaactcctgaaataaatgaaaatcgatgccccctccccctgcaataatggttgcagtaaagattaagtacaaaaggactaaaaactacaggagcactctatttttcgtaggaagttctgaagaatgaaaacagttcaaatctgaaaaataggtctgattcttcttaaatgagactcagtccccttctcattgagatacagaaagcacagtctggccatgggagaagacatttggattaacttctttttgtgcataaccctctcggtgacccacccaaaatgaaaggtgatcaaaacagaatttttggttacctcgggagaaattaacccattactaaagtggcctgtaaggtttaaagtatatacttctgccaatgaactaaatcatcttatgggccaaagcaaaacaagagtgagctaagtgttctgtccccagcagaggaggaggatttcatgcccctcattcattcattcaacaaatatttaggtcctgctctgtgccacacaccaaaagtgctgagcaaactatgcaacactgtgctgtccctatggtcacagagcttacagtagaggagataactgttacgcacaaatatgtaatactgctacgaaaaaaaaaggtgttgtatgagaaaatggaacaggaaccaatttagactacaggtgggagagaagggcactgtgaaaaaagtgacatttaagccaaggggacaacagatcaccactacttagaaaaggaaaaccttttttggcaaatgaccacaaatgggattttaactttgcctgtcaacaacggactgggttaaacctcctcttttccaatccttcaggctttctgaacatcctgactagtgtactggaatcctattacctgaacacagaaaggtctcactttattatgatttattattatctgcagccttcctatgcctggcctaggaacatccaaaaataatctgccagaggctgaaaaacagaagctggctgtcagcaagaacattacctgggtagaccaaacatttaatagcccaagtaatcataagtgccttgccaataaagtggcagcttctctgggcagcaaggtggttccaatgctccggggtctaaatcaaatgggacccagggggttcaaaggttagttggctacttcgaactgatgtttactcagtaaatcaaagaccggatcaccatttccaggtcccagaccctgaagacttaaaggacagtatgggaagtggccttttagcatcacggagcagagagctcgccaggctggaggaaggcagcagcgaaagggtcggggccgggaggaaggggggcgcaaggagaggagcgtcaggtgctctggaccccgggactgcgagccagaccaggaactggggcgtttcccgccccaccccccaacccctgtcaacccccagcaaaggcaacccagccccctccaagaccccgaggttccagcttcccccgagacaggaccaggaagacaccagcagccccgcgcagggccggagcccaccaggtccgggtgcccgtgtccgcagcgcagaggagggcgcgctcgggtgcaaaaatggccaagacaaaactctccccgcccacccgaaaaaccaaccacaccccctgcatccctcagcccgagccgcccggggccagcccccgtgatcgtctgctcaggcccccgcgggttcccgtcggcgccgcgcgcgggctcggcgggcacacgggcgcaagtgggagtgaatgggggtgcgcgaggcaggcgagggcgcccaccgcggtgtcccccgtccggaccctgcccccggggcgccctcccgggctccgcggttctgggactggcgcgccgccctcaaggctgaagtggacgcccggacgcgggcggcccccactcacccattggcgtcgagccgggccgggccgccgaggcagcgtgaaagttggcggaggcgggcgtgggggttggggcgccgggatcggggcgctgggatccaggcgcgagggtccggacgcggcggcggctgggccggcttcttcctcagtggcggcggcggcggctcagcgccgcccgctgctgcctctgctgctgctgccgctgctgccccggggcgactcctgctgc

SEQ ID NO: 1548 - DNA, 1450 bp, artificial
  synthetic oligo
ttttctccagagacagggtctcactgtgtcgcccaagctggagtggtatgatcacggttcactgcagccttgacctcctgggttcaagtgatcctcccacctcagccttctgaatagctgggaccacaggtgcgcaccaccatgcccagctaatttttttttctaatgttttgtagagacagggtctcactatgttgcccaggctggtctcaaactcctggactcaaatgatcctccccctcctcagcctcccaaagtgctgggattacaggcgtgagccactgtgcctgaacacaaggactaagaccaaactgttaaccatgcttaccactgagtagtaggcatacaggtcattttaatgttcttctttatactttcccatattttctaggatttctttcccgtatcaagcatgcattactcataaccagaaaataattacttccatttcgtgtaaagaagtaactttttaaaatgagcatctgagaccttaggggctaactgcagcaagcagctgtcaccaaaatttacacatgtaggagttagaacggctaagaaaaaatatgtcaactatctttattaactaacgctctccagaatgtggtttaggtatacatgttctagaagtatgttggagccattgctataaatctacatatcgtgttctctttagattcttgttttgaactaaggtctatgaggccagaacatcttggcgggcgctgcatgtcatctggtttctaggcagtattttagaaaggcagctcaattccccttcttgcccaataggtggggcaagaaagctttagaagagtccccacctgctaaaacatgaacaggaagagaccaaattgcagaaaaaccagttagagcggttcagaagtcatccccatccagttgggtgggatgtatgctaaaattttcctagggtgaaaactgtttccagagagttttctagagaataccaagttgagagtctataaaatctgtttcaatacctgacaatcacactgtaaccaggacttttttctagcgtttgaaattaaaatagctcaggttgaaatgctgagatatcatttttcatgggtcagattggcaaaattcaaaagcttgtcaatacactgctggccagactgtggggtaagtggcactctcatccactgctgggggaaatgcaccctggtccaactcccatggagaagggctggcaatatctaacaacattccatatacattttacccttcggcccagcaatctcacttttttttttttttttttggaatttactctgaagattcacttccaacaatatgaaaataaatatgcacaaggttattgattacagcatgatttgtaattgcaaaatgtcaaactacctaaatgtccaaatataagagtgtggttgaataagttatgataacagctacacagtggagtactatgcagcta

SEQ ID NO: 1549 - DNA, 1700 bp, artificial
  synthetic oligo
ctttagaaggccaggtccactgaacaaatggaatttattctgtcctcccagtgggcctaggaagattcggtttgtcctagaataacctacaggtcccacagtgatgactgaattcaatccaacaagctttacgcacgtctactgtgtgtggcacagccctgtcctagttgttagttctgcgtggatgactttcctgttgtttcaagatgaccctacacacgctattaggaaaatttaactaaaatataagtacagccaacaaattgctgctagctctaattctaaaaagaagttactttccgcaaaggttcaattgcttggaactctattccttgcatttcctgagatgaggtgagatggggaaagcctgccttcaccatttcttggaagtcccgaaggctggcagctttcgacactccccaggccccagtcccttgttgccagttgaatggctgcattatttcactgcagcatagaagcctcggcaggaggttcttgttgatttactgcagagcatggagggaggggaagggggtgaattctccacgggcaacacctgcagcattttagctccctctgccttttgcaaggggaccctcaggctctgggcagtaggtgatttctttccacagtgccatgagtgcccattgccatggaccctggcttggaccttagaggggaaaaagagggcactgaaacactccctccctggtggttaacgtgggggatcggtcccagaaacataagggcaagtagagtcacagtgtaagtcaccccatgcccgaatccgtggtcattgttaaaggcatgcctccaaaggttcagaattttcaaagtgtcttaaattacagcttcccccaatccatgtctctcatcaacctaggagcccatgctgggcatctgagaggtgagcctgtgtttggcatttgatcccatgtttatgaagtgaatgtggaacaacacaaaacagcccacactcattgtgacataaacattgtcctagtttgtcctattgaaggggtaagatggggaagtgactgcttcaaagaagaatgctatcttcgaaccccatgttcttgcttttaggtacaatgagaacttgaactaatggctgataaagccaagctttgctgctttgagtagatgaatggatgacaaacccttgaaaaagcactccggtaaaaatgttctagaattagtagtgatggttgcacaactctgtgactaaagaccactgtattctatacttaagataaattttaataatgtcactatatttaataatatatctatatctatctatctaatctatatctaattttgagacggagtctcatccagcctggagtgctggagtgcagtggcacgatcttgactcactgcaacctccacctcccaggttcaagcaattctcctgtcttagcctcccgagtagctgggactacaggcgcccaccaccacgcccagctaatttttgtctttttagtagagatgggctttcaccatattggtcaggctggtcttgaactcctgacctcagatgatccacccgcctcggcctcccaaagtgctgggattacaggcgtgagccaccgcgcccggcctcaatatgtattttaaagcaccttcagaactaggagtttccatgagggtcctggtcctttgctactccttttataagtgcttgctctagcaagact

SEQ ID NO: 1550 - DNA, 1550 bp, artificial
  synthetic oligo
ttgagcacggaaatgtggcgggtgtggctggggaaatgaattttactgaatgtatattttggtggccacatgtgcctagagggtctgatagtggacaatgcagccctagacagagcttgggccacaggcatagttttaggagtcatcagtacacatgtgttattagtgcctcccttgttccagaaagtatggaaggtttagaaagcaagctgcagttagcttcagaaacggacaataaaacaagacaaagggaaaatgaaggtgggaagtgagatgagagcagagctggtttagcacaacaaaggctcaacagaaagctgttgtgtaaaatgtgggccctaaatcttttgacgccataggaaactggcaggatggcagggacactggcagaacaggcgggagcagtgctgttcgggagagcttgttgggagagaagctggtccaggactaagggctgaaagcccaggcaacatttaaggggatgaggggcagacagaggaggctatgaaggagaggccagagaagcaagggcaagcttgacaaggccaaagccaaccaagaaactgattagtagttaggcaacgaggaggagtggtaggtgtgaggtttgaagactgaatgtgagttgagaaaataaagacagaatgttcaatcaagtctttcaggagctgggctgtgaagaaaatgggagatacagacggtggtagctggaaagtaaagaacatcaccttctttagcacacgactacgatcatgttactcaccagctcagagcctacatggtatctccatggcctgcaattatcaaggcctgtcatctgaggtcctgtgattcatctttatctcttgtgacctcccttcacacaccttaaggcccacccaaaccagcccaaacatgccactcgacaaaacaaacaaacaaacaaacaaaacacgtctgtattgaccaaaatgttggaaacaggaaaacaatcaaagaagtcccaaatttcaagaagggactgtcgagacctaccccactgtcccttttaaaaaatagatcagcaaacctgtaatcagagaccacaaagacttaccaaggtcactaaaggatcaataatattctattatttattactctaaattcggtgctggccttgaagtgctacagcattgcctgcttcctgtcatgataattctctaaacagtattggattgtactctgtgatgagcctaacggcttcctttatcaatttaatgataaaatcgaccttgtccttcaacatgctttcctctctaaataaaaagatcagaaaaggaaggtctgtctgtattgtgacaaagtaccctggtactaacatcacagtggttctcaaaccctggcaagctactaaaacagaacagggctgagtccatgtgtttttactgcattccccggatgattctgatgctcttcaaggtgtagggaccactgcaatgatgtcttttgtcttgctcccagatgggactccccatacctcactgttcttagactatgcggttgcccctacacacaaccctatgcctagggga

SEQ ID NO: 1551 - DNA, 1700 bp, artificial
  synthetic oligo
agcctgggtgacaaagtgagactctgtctcaaaaaaaaaaaaaaaaaaaaagtataagggaggatgtgcataggttacacgcaaatactataccattttatatcagggacttgggcatccttgatttttggtgttcttgagaggtgctggaacaaatcccccatggataccaaggaacgactgtacttgcctattacagtagatattctccaaaagggccactaacaatttctcatttcccagtaggtgcatgctgccctcacatcaacaggtggagtctatttcctctccccttgaatctaggctggccttgggacttgctttgaccactgaacacagcaaaaatgacattctgggacttctatgtgcaggccttaagagaactggcaacttctgcttccttattcaaagcacagcagccacgctgttagaaagtccaggacagactctctgtgattaggtacctggacaatgagagaccatcttggacatttcgagcccaactgagctcccagcagaccagcagactgtaccagcatgagggactccaggtgaccccaaatggagcagcagaacttctccaataagcccaggcaacccccagaactatgagggttggcacataagtgctcaacaattagcggccattactgtctgggaagctaaaatgaacatgtgcagtatataactgcagaccgctgtgtacattacattcaggttctgagcgctttgcaggccctgtggagtgggaatgtacaggaggtgaaaaggcaaggcttcagggtaaaagcgcgtcttagacctgaaggacagagtatgcagaatattggtttctaaacctctaatgcatgaagacccacccacagacttctaggcaattgcaacgcgtgtctgcaccaaaggctgaagactgtcccggcagaagtctcgtggtctctatatagacagatgggtagttgtgaggccgggggaatgaagaatgtcagtgagtatggggattctttgtggggtggtgaacatgttctaaaattgattgtggtgatggctgcacaactctgtgaatatactaaaaaccatcgaattgtgcattttaaatgggtggactatatggcatatgaattttatacagatgataaagctgtttatttttatttttgagtcaggctctcactttgtcacccaggctggagtgcagtggcacaatctcagttcactgcagcctcgacctcatgggcttaagcaatcttcccgcctcagcccctaaagtagctgggactacaggtacgtgccatcacgcccagctaatttttcgtattttttgtggagacagggttttgccatgttgcccaggctggtcttgaactcctgagtgcaagcgatctgtgggcctcagcctcctgaagtgctaggattacaggtgtgaaccaccacgaccagccataaagctgttattacagaaacacagagggtgggacggatgaagcgggtgagatgacaaaggagcaaggaacattccaaagggttgcctgggggctacaaggcaccaacctatttggcactgagaggaaaagccaagtctttttaggtggtgaacgaacccagcactggtcagaagctaggagccctggggacagaccctgtcattccaaggatctcaggcatttggcatcactgctgttgcctcaaatgctttgcatgca

SEQ ID NO: 1552 - DNA, 1500 bp, artificial
  synthetic oligo
atttaacaaaataacatttgttcaaaaaatagagttacatcagtctggaaaagttgcaagatgactaactatggctcatggcacaatctctacctcatatacatccaaagttcacagctctgtacatatagatttgtcactactgtagaaaatcccaaaagtgtaatcatcatcacctctaggaaaaagttttttcctttcatctggattatccaaattatattatccaaagcatatttatttcgattcatatttatccaaagcctatttattttttcacaaaaaaaggaaaggtaatagccagagactatttaactttcttttcagagagaaagaaaggtaagatttaggctcaaatcttatctcatataagacaatagtttaacaaaatacatggttacatatgtttcatgtgtgtgaattttgttttttccttgaaatgtctccaataaaaattattaaggctattttcctgattgacacagatcttaaagaacaggcatttctacatcaatttgaacattttatttgagaaaattcaaattttggaaaatgtaaggttctaggttcccttccagatacaaagttcaaagattttagagttgcatatgatgaaagacagtaaaatctataaaggtgaagacaatctataatacaaatacatgaaatgtttaacattctttccagttaggcaggatggggtcatgataagagcagagacaggcctgtgtccaaacttcaggattctttatcttagcttcagctttgcttagaccggcatgtagttgctgttcaacaaatatttgcagaataaactttgtttttctcatctgaaaataggaataataatacttgccttgtatgattggtgggaagattaaatggaggtaatgtctgtaaagcattaagcatggtgcctgccacataggaaacattcaataaatggaggtattgttatcagctgcagaaagggagtactcctgcatacataatgtaattcaaatatctcactcttgaaagttacctcgttccatttgctgtgtgagcattttattgtagtgtgatctatttctttagggcactcttgtatcacaaaaaatgatactgtaagtaacctgtgaaatgcaaataaaagaatgtagagcaacttactcttctgttttttgagctacatatgttgaaatgcaaatgattacaggtcaattgcctcataggctatgatcaaaatctagtttatgtaatgctcaaaataaactaacaaatatatgattcaaagtgaacattacctgactcatacttatgtagggagaatgagaggaagagggaactatgaaggagaggcctgtgtcagacatgctttaatgtcttcttcttttattggtttccgaaatgtttaatccttagaggtgtcattttcttccaagagtcatttgaagggaaagaattatggggctttgatacttgacaaggaactgagaagccattctggaagctttaata

SEQ ID NO: 1553 - DNA, 1950 bp, artificial
  synthetic oligo
ttctgcacatgtatctcagaacttaaagtataataataaaaaaagaaaagcaccactttgaaaaccataatggaataattgattcaggcaacaatcataaatgaataaagccattagatgaaaggtggatggggaacttgaaatgggaaggatcaggctatcaccacctgaacccactgattaatctcagcattggtaaaggtgaacaaccagtcactataagcctcttatgtcatgcaataagaaatacttagtactacctatgaagtattgttttcaaaaacctgaagctgaattcagttaagcctctatagcttcactgtccaatacggtagctatgacatgtggatatttaaattcaaattaattaaaataaaataaatttaaaaaattcagttccttattcacaccagccacatttcacgtgtcagtcttcacctgtggctatggtatcagacggcgcacattatagaacattcccaccacggcagcgagttctattggaaggtactgctctagagctttcatttttgcggggagacaaaaggactagagaaataaattaaatgacacacaaggaagcaaatagacaaatacggaatgtgatatattctctaggtttggttaacttactttctgcagcaagtcaatggaatgaacgaaaaagaggaggggtaattctttgcattgagagaggcaaccagaggtaatgtgtggaccttgtttggatcttgatttgaacaaaccaattgtaactacatttttgagaccatcatgaaaatatgattatggacagaattttggttgtttttaaatgtcgctgcaaattggtatcccatttggctcttggaatctgcccatttccccaactttaacatctgtggtagcttcaggtgagtttttcaggtctgatcacaaaacatcctggatataatgaatgagcaagcagggagcaaggctgaaccaggcaaatgtgggcatctgggatggcagaagggctgtcctttccctggcagcaaaagaacagcccacggtaaacaaatccctgagtgtggcagaactttaggaccactctaggcatgtatcactcttctagagatgtctgctctctgggagcaagacggggctgtggttctgtgaaggcttggaggccgaccatattattaatagcggatagtcattctgatgtgaagccaaggctagatagaactgaggtccaggatcaggagatgggactggcaaaaataagaaaagaaggtaggtccagggctggaatttccacaaggatattatcagcctggaaaataggataaatcatgtgaactctagaatcctggagagatgagggccagataagcagatggctctcttcctccctccagtgaggaaaggctaaattctggagccccttatctgaaagtgatagagaacaaagataagagaaccattttcaaactccacctggtagattggtttccattagttccagattgggcaacatttgtttccttttgttccctttttcctgttcaccctaaatatggatcatgtctaaagttctatttttatattttatttttaattgtggtaacaaatacataacataaaatttgccatcttaccgattttgaaatgtatagttcattagtgctcagtacattcatattattgtgcaaccaatctccagaacattttcatcttacaaaactgaaactctgcacccactaaacagcaactcccattttttcctctatcctcagcccctggcaaccaccatactactttccgtctctgtgagtttgactattcgagatatataagtgaaatcatacagtatttgtctttttgcgactggcttatttcacttagcataatgtccgcaaacttcattcatgttgtagcatgagacaggatttccttctttttgttttttgtgacgaagtcttgctc

SEQ ID NO: 1554 - DNA, 1050 bp, artificial
  synthetic oligo
tgttatagcaacacaaaacagactaagacaacgttcctttttttttttatgtttttgagatggagtttcactctgtcacccaggctggagtgcagtggcccaatcttggctcactgcaacctctgcccccccgggctcaagcgactctcctgcctcagcctcccggagtagctgggattacaggcacccgccaccatgcctggctaatttttgtgtttttagtggagacggggtttcaccatgttggcctggctggtctcaaactcctgacctcaagtggcccatccccaccttggcctctcaaagtgctgggattacaggcatgagccactgcacccagcccgacaatgttccttatagatacaaggagggcacctcttgaatgaggatcttatgacttgcttcaggggaaggttagaggatccttcctaggttttatgacctgatttaggggataggggtgaggggaaggtcagagagtaaacttcctgcttctgtggttttctcaaatgctaaggccccatgttttgggatagtgtgtcctgaaccccatcattagccatgtttcccatcacatggaggaagtcagtttgcaaggaagaagaataaagccaaggagtataaagaagtacgagagaatccacttcataagagaatctcgatgtatctcttattctagtagtttctaaggctcagcaaatcacatatctgattttagattttatgagaaatctttatcctaactttcctttttctgctctaacaagtttgagtatttctcacttgcaacagaaagagtactcctaatacacacaagtgtacatgaaactgtccttgcaatatcaggggattcactaggagctaagaagtcctctgtgcattagtgtaattactcatgatcaaatggattttgctaattagacatgaatctcctattaaatgaagtaagttctacatgtctcccatttacaaaaagtctgttagcaggttagattattgtatacgtgcatgtaacaaactctgtttcattagcagggtcctacaattcag

SEQ ID NO: 1555 - DNA, 1800 bp, artificial
  synthetic oligo
ccaggtggggaaagataacctccacataacacataaaacctgctggcacccagtaggcccataggtagatgtcagttccagattttcagaatggaagaagatagcagaattcactgggtgaggcagccccagtgccaaactagaccgtgattacagagagattaggctagattctggcttgagggcaaagatgagccagattgacgacttgagctcaagtttaggttgcttttacttctgttttctcccaaagcagcaaacaaggcatgcagatgtatagaaaagaacacagggatgtagaggctactcctcatcacttgtctggcttttcttggtgatcttggcagcctgaaaagagtgagatgtcctctaggctagaggagcccagagtccgtgggcccattgccttttcttgcccccttttttctttttatttctttcttttttttttttttttgagataggttctcactgttgttcaggctggagtgaagtggcacaattatagctcactataacctcaaacttctggactcaagtgatcctcccattttagcctcctgagtagctgagactacaggcatgtgtcaccatacctggctaacttttaaaagtcttgtaaagatagggtctcctaatttgcccaggctggtcttgaactcctggcttcaagcattgctcccacctcagcctcccaagtaattgtgattacaggtgtgagccaccacacccacctcccattgccttttaaactccagcatgtcaccatccagaaacaactcgtacagccaaataaggcagtggtctggtactcaacacacctcctcactcaggcctaaagctcacatttgatccttggaattcttgctgcggcaccacggggcaattgcctctgatctgtgtttgcctggtgggtcctaggagttttccgtttatatttacttacaggttttccaaagcaggtctggccataacctacagcacatgacctgcacacatgtccttctttctcccccttcctccctccctccttctcttctctctctttttaaatagccgttatcttttagaacagtttcatatttacagaaaaattgagctgatagtacagatagttcccatatacttcctgccccccatccagcacataggttcccctattattaatactaatattttttattagtgtaaaattagtattagtatatttttcacaattaataaaccaattgtgatacatattattaactaaagcccatatagctcattcagcttttcttagtttctctaaagtcctttttctgtttctggatcccatcccggatgccacgttacatttagttgtcacatctccttaggctcgtcttagctgtgaccgtttttcagatttttcttggttctgatgaccttgtcaggtttgaggagcaccagtcaggtatttggtaggtggccgttctgttggaatttgtcaggtgtttttctcatgattgggctggggtttgtgagtttttggaaggaaggccacagaggtaaagtgtcattttcatcacatcatatcaagggtccataccatgaagatgatttatgacttgatgtttttcttcatcatttttctgaaatactgtttgtctgtttttttttccactgtaaagttactcttttattcctcctttccattctgtacactttgctgggaagtcattatgtggagcccatgtttaaggaacggggaatttttctttacttcgtttagggtggagtatctacaaaatttatttgaaattcttctgcatgggagat

SEQ ID NO: 1556 - DNA, 1900 bp, artificial
  synthetic oligo
gtcccactcaacattctttcccataaaagaacaaatacaaacctgtaaaactattatcacaactactttaaccccaaacaaactgtgctttgaccaaaaaggctaactctttttggagtaggtttttcaatttatcctctgctcccaccaaatatggatgggattagcctgactgcttgggtctgatggtgtcacatcagtgggcaggagagaaaatgcagaaaggtcagaacacgcttggctaagaggaattgaagccagagacaagtgaggtgatcataagagagccgcaagctgctataaatggattttcatcttctgacacagaaaaaatgataatctgagggaatttagacaaatgcagttgaaattgctgagccactgctggtaattctgagggaccgtggggaagagaagagctcaaagattggaaagggaaagtgtcccaatttcccaaaaactctaacctcaaattggaaatggaattcactcaaaattctaaaatgaattattaaattgagtggtttatgggtacttagaaagggaagaggggttggctaggaaatggcttggagccactgtgtcatgctgggtgagtcccatttccatgtgaatagagttagtgccctggcagactaggggcgtgctctggcatcgagactccacaactagattttagataggtttgtcacagtgtttttacaaaaatccatttcctgctaagatggagaattacaaataggatgaaaaacagcgggggatggtgtgtgtctggagctggttgaacaaccctacccagagagtgctgatttaatggtaacccagaagagttccggtagtaatagtaataataatgataatagcaatggcaatgatgacagtaatagttgcagttacttattgagctcttactatcttccagacattgccagaaatgctttccatgtattaagctacttcaccctcacaattatgtactccatgaggtaggaaagatcccgaaatatgctcatttgcaaccaagtacctcacaattatgtacttcatgatgtaggaactgtgattatggctgggtctgtagacgtggaaagtgagcaattaagttatttgtctaaggccacacagccttagacaagaggttctgaagagaaaaaaatctgaaaaaccatacttagacctcatattgcaaagatttttagctgaaaagaaagagtgacaaagaatctttgtccagagcagatgactgtcttgttaaaatattcttttttttttaactttccaaaaatgaagcattctaaataatggagctgggatttgaacccagtcctacagaggacatgtgtatatgttggagcatacattcaagatctggctatagaaacccaggctccaggaagtagtattatgtttcttccatagtagcttgcctttttggggtttttgattcaataggggttggggtgtgggtgggtaggtagatgaggcagccacttctggctgaggcaccacagtttttttcccatttgcccagcataggtcgttcttgccttcagtgggaagccaagctgaggtggtgggaaaaacccaagctgtggagtcagagcaagcaggttgatgtgtgaactttcagtgttcttcctcttccaggagcctcttttcttaaaacttactctgattgtggagtgaatgaaatgctatgacccctatttaagggatgtgaggtgtttgcctgcaaatgggcatattttggggtctttctctgagtccccgaatttcctccagaaaggtcccatcacattggtgcctgtgtgggcacagtttttcctcagtcctttgtattggtgcttctcagactttaaagtgcattggaataccctggggatcttgttaaaatgcagat

SEQ ID NO: 1557 - DNA, 1050 bp, artificial
  synthetic oligo
gaaagaaaacagtcttatcccagtttattgatatacaaacagagcacacagagtgagagtaacttgtttgagtttatcagcttttggtttggagagtttgccattgaacccaggcaattggaatccagagttcagccttttaattacctgtaatcaccagtttctgtatcaactagctattgttgcaaccaaccacaaaaatctcagtggcaaatgataataagctttaagtttccacatgtctgcaggttggtgggggcagctttactgatttcagctagactcagctgggtagctccaactgtagggtgagttgagggtttcttcatatgtctctcatccttcttgaattattggcttaatcatggtctgttcttctcatggcgataaaagaagcaagaaagagggactcccatcagaactaaggcccacatcaatctgtctcctattttgggctttaattgcccaagtcaagggagggaaaagtagaaaacggaaggtctcttttgcaaggcaaggaagtcccgccctgatgtgctcataatggggaaaagaatgcaaggcctaggagctccttccataggccggctggatcaagaaagtcagatgaagagggggggcatttctgctcactgacatttttgccacctgaggaaagatgaatggatgtcagacttctgtctgtattcatgaaatgtctcatggaggaggggagtgtggggtgaaagcttctgtctaccccttctaccgcttctgaggaagtgttaggagaagttactatgtaagggccaaggaggcacagaaagagaataaccttttctcgtatagaaggcaaggactgggttctttacatcttagtatccctcttctgacatggaagtttcctaagaagtgtagtcgaacaataagtgaaattcgcattttccattcttgaagaagaacctccaaaatttccctctctgaaaccttacttcctgggggttccacttggcctggcaacagaaaccgtgtttgctttctgaagagtattttggccatctgttttggttg

SEQ ID NO: 1558 - DNA, 1900 bp, artificial
  synthetic oligo
cctcttattaaaatttcaatacaaataagatttagtttgcttagtgctctcagccacctttgaattagttgagactacaagtgtataaaacagacacacttgttacattctgattttctcttatttagtgtagaacatttaagatacctatgatgccgggccactttcagaaaaatacaaatcattccttcaacttcggcaggtatgacagtcgtgagtaaactgtcagcatctatttgaaaatgcgaagggtagagaatggaactcgtaaatttgacaagctctttatgttccattcataagggctagcgataaatgaatcttgatttaacacttatttgtactgttattggctttaaaaaaaaaaggaaaacattttattgcactctgattgtagattatgcttctcgggactcatccctctgtttagcaacatagggcagatttgattcaatatttaccatgtaaacacatggttcagtctcatgagtgaccatttctggttacccggccccagttgagtgcagcatttccactccatctccagagatctttatgttagtttaaggcagttgaaggccttgtgcaatgttttttctttttgctacatatgatctcctctattaagtaaatagcttaaattgtattcgggttaccttggaatacgtagtatagtagcattttacctgtcgactgaaaacaatttgcagaggaaagctgatctaatgctacctccttgcttaatttgtggcttcttacagaatatagggtaaactcattttcttatatccatgtctctccactacctgtccccaggaaacctctccaatcctatcattaccaaccatttgctattatgaaaatgatctctgagtatgctttattaatttctgcctccctctctccctcttccttcctccctccctccctcattctctctttcctccccgtccatctctttcctttttccctccctccctctctactggcctctttctagtgcatactcattaagcacctacagtatggtggactttacacttagcatggtaggaaagatgaaatcgacaatgcagcccccagcactgcaggggatgtggacagaagcaacagtacttacagtatctataatggtgaatgaattacccaactttgcttgaggaggtcagagaagttttcagagaaatgatgacttgtaagctgagttttgaaggataattggggctcaccaggtagacaaagccaatacatttatggttcacagaagcaatggtacaaatggaagagcagaggcaagaaacaccacatctgtgctacctcccttctcccttccctctctgccttccttgcacacatatttagcgggtgatcatgtggcaagcatcgccctaggtctccagagacaacactagacaagaaggacaatattcctgtcctggggaaacttatctgctagttgtgaaatgacacatgatttgctgagactaacagctcctatatccctaaacacttcaaaaaatgtttgggacgtgttgcattctgaatgctgcctcctggagtttcacggtgcacaatttcacagtcgaggccctgggaagtccttcatcaagaaatctgttatcttcatttactgtggttctcaagtgcatttaaccaggggaactttgttttaagtagcaattaataccacacaaagccagttttctaaaggagtcactgcaggaaatgtttgagtgttcgtttcttccaatctcattgcctattgtatcagttgcgtgttttcataataatgctgcataaaaacagccacagaacctccgtggcatacaacgataagaactcagtgcttgcacccctggggaggttggttaggtggctctgctgaccttggctgagcttg

SEQ ID NO: 1559 - DNA, 2200 bp, artificial
  synthetic oligo
ctacttgataaatagagtcaaaatctctatataccaagaaccccggatgatctgtaagcacagccaagtttggggagcgctgggctaaatgacgcagtcactgggaatgcttgaagacaaatgaagcccagaatagaagcgtcatttcccaagtagtaagagtgctggccctggaagcaaagaaatgtagatttgaatttcaacttgccacttctagactgtggttttgagaaaggtacttaaccctctctgagcttcagattcctcatctgtaaaaagtgtgaagcaattagcatgatgtttggcactcaggaagtgcttagtaaatgttaacacaacagggcttcatggctgaaagcacagactttgcagccagagtgcctgggttgataatcctggctctgccacttcctagctgggtgaccttcagcaagtcacttaacctctctgagctccaggttactcatctgcaaagtggaactcacaatagggttgtgatgacaatttcatgggttaatatctgtaaagcatttagatacagtctggcacatagcaagagctaagtgtctattaaaaattatattgctattttagagacttgatgaaaggaagagagccaggcatacatgtttttttttttttttcaagcttcaataaaagaggagtctatttctccctcatgtaaagagagtcaggaagtgcgcagccctgtgttggctttcaggcatccacaggacctagatgcctccatttgactctgccatgctcatcctgtggattctgtccttatggtggagagaggcttgtgcagctctcactcctgtacccaggtacaaggccagcagcagaatgaaacagctgaggagggtcaaggggttctggattagtggtgtattgctgtgtaataaattacctcaacacttgagggctggatatgataaacactatctcacagtgtctgtggctcatcatcgggagcggcttagctgtgtggtcgtggctcatgctcttacaggctgcaatcaaggtgtcggcaggggctgcagtcatctctagctcaactggggaggatccacttctgagctcacttctgcagttgttggcaggcctcacaaggtcccctttcaagcttacttatgtaggcccctccagagggctgccttatgacatggcagctggcttctcccattagaaatttagcccacactcaagcggagggggttgtacgagggcctaaatcccaggaggtggcatcataggggctgcatagcacaggcctcttcccagtgactcagcttccctcaagcagccttcctggaattcccacacaacacttttgtttatagctcacaggttggaacttagtcacgtggccataccaagttgcaagagaggccgaggaatagaatcttttagctagaggcattttcaccccgaattaaaatcagggtctcattactaaagaagaaaggtagggatggctagttcattttctatagccttcctatagagctgtggttctcaaagtatggtctctagacctgcagcatcagcatcactggggaactggttagaaatacaaatgtttgggctgcatcccagaccggctgacccagaaactctggggatgaggtccagtgatctgttttcacaagccctccaggggattctgatgcacgctcaagtgtgagaaccactgctacagaggacaattgacattcatacgattggtataataaaacatgaagtctgtttataagaaccgacaaaaaataagaaccaacaacttggtggtgtctttagacagtatcatcatgaacggagaggctttcaaaaatgaggcgtgtgctacctaatgattcagttacaattcactttgcggtttccatcccgaggttgcacataattttatcaggcaataagctccattgtacagataaaacttgagggtatacttggcaaaggagatcataaatgaagatttctttatgatgagcaaggaactatagattctcggtggctagaaattccatacttaaatagtagaaccaaagtcgggttatgtaagagactacttaaataatcaaatccagcaaagctgaatgttttaatcaacatgcaggaaacaataaatcagggcaggctgtaaaaaaagtggaggacttcaataacccacaagtaaattgttgggaggaggctg

SEQ ID NO: 1560 - DNA, 1050 bp, artificial
  synthetic oligo
ttaatcaagcaacagtgcattctcacagagaactgaataatccttgggtgggcgctttaaatggaggccttttaataaagcttcagtctggaaattgaaaggacaagcagtcattctgtctccttgtttccaggtgttaggtaatttttcttaacatactcaaacattgcctacatcccacccaccttaacacacacaaaaccgatctgctgagagctgatggaagaaagagttatgaatggattaaagagcctataggaataaaagatggggatttaaagcaagcacaggtttctgcttcagagacacaagtgaatgggtatctttaaaagcctaaatatgtgattttgttgtaaacctacatattttaaagatgtttaaattacgctttccttttaaaattaccttttccttttcaaaatctagatagacttaactaggcctgaatgattccattaccaaagcagattaatatggttaaatgaaactgtaagggcatgtgataattatttttcagttgtcacaggttacataggttaccatagcccattaatgtatgctagcctattaagttactgaaatgacaaacattattgcatcgataaggcatattcagtccagttgagatagaaaccattctccaaatgatagtagtttccaaaagaaacctatttttaaaaatctcataacagctcatttgtaatacagcttgctgctcagatggtttctgaaaagtatcttcttagagagaaatcaaaacatctcatatactccataaatatacacacctattatgtacgcgtaaaaattaaaattttaaattttaaaattttaaaaaacaaaacagacaaaaaaaagaaaacaaatattataataggacaaagcctactctgaatagcaggttccccatggaattttgttttctgagtagagagcaagatcatctgattaaaaggctcaaattctctgaaactttctattgaaggctatgatgtgtaacatgagcgcatttccatattaaggttattcagctgtggaaaacaccagaac

SEQ ID NO: 1561 - DNA, 1100 bp, artificial
  synthetic oligo
tttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaattttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgtagcaaacctgcaggaggccatgt

SEQ ID NO: 1562 - DNA, 1000 bp, artificial
  synthetic oligo
tcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaat

SEQ ID NO: 1563 - DNA, 1750 bp, artificial
  synthetic oligo
atcctagggactaagatgcccagacccagaaaaggcacatcctaaaagcctgcattgaatgggaagtcgaacgcacactatctcaggtaagagatttggcagaggctctgttatggattgaagtgtgtcctccagaacatttatatgtgaagtcctaacacccagtatctcagaatgtgacactatttggagatagggactttacagaggtaatcaagttaaaacaaaaacattaggtggccctgttccaatatgacgggtgtcctttaagaagaaaaaaatttggacacagacatatacagagagaatgccatgtgaataggaagacagtcatctataagccaaagacagaggcctagaacagagccttctcttgcagcccttggaaggaaccaactgccaacacattgatttctgacttatagcctccagaactgtgagacaaatttctgttgtttaaacactgagttggtgctactttgttgtggcagccttatccgactaatctgataaagccagccttatcagacttggccttggtctccaaaggccaacataataaatgtcaaatactgccataatctaaagtgaggcactaggacaccttgcgaagaaatggaaacatacaggatctgctggcattacttgtcacttcacttatatgtggaatctcaataagttgaactcatagaaagacaggagaagggtggttaccaggatgaagttaatgggaagatgctagtcaaagggtacaaactttcagttataacatgagtaagttctggagatctaatgtacagcatgatgattatagttaatgtattattctagattgggtttctacctgcttagaagtgaccgcaggacagttcgttaagagcagccagatgactatgggaacttcctgagattccttcccatacaaggaaagaacattctcaagccagttgtttcacataaaaagaaagttactttctttttgtttccatgaaggcagctcaacaacaacacagttgtggacacagtgaacgaatttctaactgaatatgctccagagaaatcggacagccaagaaattataatgaggacttcaggatggcactcctctctggaatgtttggtagccctaaggtaggagatacatagcaacttctcagctatgcacaatcctactgttctagcatttttcagtggatattgaaaatatgaaaaaataaaaaggcccccctgagaaaaccaactagtataaattcccctgcttaaaggaggatttcatacaggagatgatcctctgggaataaaaaggggctactaacccaaaaagagctgatggcagtcacacatgtggcagtctgcatgtaccctgacatctcacagaaagatgggataaagggacattgggttacacacacattatacctgccttgtcttcctgaatttctccccattcaacccccttttatccttttgttcccctttgtgctctttctctactttttcccatgtttcccatgttcttattaagctgagtgctatctatgaaaaaaaaatgcaatgatactcacaatgaagactggaccccaatcattcaaggatgctttcctagccatagctgagcagggagcatcctaataagatttatttccacatactcatctcccatatatgtggtttcctaaatgagatttgttctccaacgaccatggaacacatccagattctcctcctacccttttcactaccaactgca

SEQ ID NO: 1564 - DNA, 1050 bp, artificial
  synthetic oligo
aaaaaaaaaaagtgaccaaataatagtatggatagtatggtttattgagcactaattccttaaataagcactaatcttatttaatactcacaacaactgtatgaggtcagtattaccatcttatagataaggaaattgtggtttagagacattaagtaactctccaaaaagtcaaatggccagcaattgatggctagcacacatttaccaaacattaggttggtgcaaaagtaattgcagtttttgccactgaaagtaatggcaaaaaaaaaaaaaaaaggaagtactggctattatcagatgtgtaattagttgtgtccttctccaccagagggcgcagtcctgcacccgagacttgtcacgaaaacccgataatggggtagatctgaaagtaggttcatgaccccagtcattgataacagcagtcactggtggaatcaggggactctgcagtcacaggactcaaacttggaaatgagacatcatctagaaacctagatgatcacagggcctcaaattgtagtattcaagttcccctttcatgtacatattcagcattttccaagccttcagacaagatttctcccttttggtttgtctccccatggggacaaatgtattctaatttatttttactctggtaaattataaagtaatgaatgacagatagttctaacttaattgacgggctccccaccatattgcaaataaaatgacttgaaaattgtcatctcagaagcctatgtctgcatttaatttttgtaatctaggactcttttccacctaaagccaataaataaggaaactgtatttccacttctttccactgtactttggcaaaaatagattctggacttcttactactatttcattgtgccctttcaggtggatgtgagtctgtgtcatttattggttacatccttacacatgtatcattcttacccatctcttagtcccgtctaccatggaaacagtaggtgatgacaggatggtaataagcatgaaattcaaaaccagaaaggtgagctgatgctggagctacagggtct

SEQ ID NO: 1565 - DNA, 1750 bp, artificial
  synthetic oligo
gcacacctcagcctcccaaagtgctgggattataggcgtgagccatcgcacctggctgagtttcatctattcttgattcataaccatctgctttttttttttaattaattttttttttatttttgagacggagttttgctcttgttgcccaggctggagtgcagtggcatgatctcggctcaccgcaacctctgcctctcaggttcaagccattctcctgcctcagcctcccgagtagctgggattgcaggcaggcgccaccacgcgcggctaattttgtattttttaaatagagatggggtttctccgtgttggtcaggctggtctcaaactcccgacctcaggtgatctgcctgccttggcttcccaaagtgctgggattacaggcgtgagccaccgtgcccggcctgtttgttgactttaactgcactcatttttaaatcctttccagattgctctattacttctattttcttttatgtgaatcttcttatatgttgggtttcattgtagcctttgtaatttttttttgagtgctcatcttacacggaggctttttttctttcccactctccctggaaaatggttttatgattgcttcagcccagtgtcctgagaacaaagttcagtggctctgggctcttgccctgtgagtatatcacaattccaaaccgggagcttgcatgaaatgtattcctggtgcctgctgtgtaaatatctctgcttttccactctatcacaggcaagaactttgtttctagttgcactctccagcagctaggtaagaatttttcagacatagctggttgagcatgagctcagtgcatcagttttcctgtgaataggtgtgcagtggttccttattccttggagttgaaattccagacttcgctatttgtgtcaggtcctgggtgctatgggccaatgcgttaagctcccacttattgctatgggtttccactaagtttccagtccatgaattttaaaaatcatgtccttgagtattttctgaaacacaccatcatttcttacatttttgaaacacagtgaagaaagcttagcatatgttccccctgaatcaacacagtacagaaccactgttttgtctaaagtcttgctactcaatgtgtggtctgtgggttcgtttcaaatgcaaaatctcaggtccacctggacttgctgaatcagaaactgctctttaacaaaattctgcagatgatttgcatacatattaaagtttgaggagcactagtttaagggtcagttagttctagtataaccaacctgaacaaaatcagacctttagaaagcttttatttccagctgggtgtggtggctcacacctataatcccagcactttgggaggccaaggcaggtggatcacttgaggccaggagtgcgagaccagccagggcaacatggcaaaaccacgtctctactaaaaatacaaaaattagctgggcatggtagcatgtgcctgtaatcccagctactcaggaggctgaggtgaaaggatcgcttgaacccagtaggcggaggctgcagtgagctgagatcacgccactgcactccagcctgggcgacagagtgagactccatctcaaaaaaaaaaaaaaaaagggttgaattcccttcctccctctcctatctcttccatgttgatatatcttgaattttagttacaatttggtattaaagactatgaattttataagcaataatttagacctaccacgtatcttattaatt

SEQ ID NO: 1566 - DNA, 1600 bp, artificial
  synthetic oligo
cgggaggctgaggcaggagaatcgcttggacccaggaggcggaggttgcagtgagccgagttcgtgccactgagttccagcctgggcaacagaatgagaatctgtctcaaacaaacaaacaaagaaaattagttcacagatctctgagagggccggagtgttggacttaaatgttactcagcctggagtactgctcaaaccgcatcactggctgtccagtgaagaccactggatgtggacccacagcttgcacctgtgatactgagaactggattccagaacctctggattctggatgccgttgccaccctcaccagaaagtaggttccatgtgtttcctgcttcttcacattgctcactttgtaatcagtccgattttgagatggctgatggatgagccctgggtcgtgtgtgaactgtctgcaaaggaagccgagaaagcaagttttctggcttctaccaaggaggcaggactaacaaagcttccaaagatgctgggaagccaggaaccttggcaagattccttggcactatgttgtgataaggttgttgcaaacacctttgggttatttctagtttttttttttaacttatttaaaataatgctgtctgttattatacattttgggctagagattttactttagggattataatcccaaagaaacaactacccagctatagtaacatggtacttattaccttattgatagtaactactgaaaaccagaaagagctcaagcatataaaaccgtggaacaacagactaatttgtgatctaacaaacgtctaagatttccacagatggtatgaattccaaatatcaggtcacattgtcttcacctgtttatgcttggccagaccatgcatccagtttactttgaaatgtgtggtcactgtgactacgtaattttatcctgatggaatattataacaaaaatactaactctatgttttactaggtgaatacatggaaagcaggtacaaaatgttttatgaaagaaacagaagagtctaaatacactcattgtgaccatggaaaattagtgtttgcataatgcaaagggtttgcttttggtttgtaaagttatttaatattgaaaaaggaaattcccttttgtttttcctaatgtttgtattaacctcagagcttctgaagagcttgcccaataggtggcagtactggataagaacagacagaaactgctgcaggctgccttcaagcgctgtttctcaaactttggtgtacataccaatgatcatgttaaaacacagcttgttgggcctcactgcactcggagtttctgagttactagatgtcttagtctcgtagtgctgctataaccaaatacctgagactcagttatttataacaaaatacctgaggctgagttatttataaagaacagaaatgttgcctcacagttctggaggctgggaagtccaagatcaaggaagtccaagatcaccgacaggtttagtgtccggtgagggcctgctccatggatggtgtcttctcctagcatcaccctcacatagtagagggcagaggggcaaaaaaagcctaagccgttccctgcagcccttttatatggcacgg

SEQ ID NO: 1567 - DNA, 4250 bp, artificial
  synthetic oligo
cgaggctacagggagctatgattgtgccactgtactccagcctgagcaacaggctgacaccctgtctcaaaaaataaataagtaataataaaataataaatacattaaaaggtcacattctgtgactcagtcacactgttagagtcacaataagtcatgtcatgcttcatcagcaagtcgtctcagtccaacagtggtattcggtattttctcatgcctgattcaaacctctgtaggcttgagtgggtggtattttgggggccatgtcaccattactcatccactcatccagtcaagcaaccaagcattcatacctttagttgtttattcattcgtttgtttaaaaaatagcacctactacacattagacatatgataacatgtaactgctagtttcattatataccccgatcctctagaatctctaaatggataaatttcctaaataagtgacattctagtaatacacagacaataaacaaaataaatgagtaagatatatagtattttagatagtgatatatgctaagaaaacaggaaaagggattgaaatgtcaggggatggatttttttttttccagacagaatcttgctgtgtcacccactgcactggagtgcagtggcacgatctctgctaactgcaacctccgcctcccaggttcaagcaattctcctgcctcagcttcctgagtagctgtgactataggcgcgtaccacctctctgggtctctgttttctagtttttagtaaagtcagattggattagtatttgttaactatttttggtttgcaaactcctttgcaaacctgatttaagaaaaaagagctctctttcctgcgtcatgcatctccgcatatatatatatataaaactcagaggccagtttttcatggtctctctataacctattccaagacctccaaattaagaccctaatgttgtgccttcgatgatcaccgtaactgcctccgattttgaatgatagaaatttcagaaattgcaatgtgtgatttagggaaattttgaagggtgtcgagttgttctcagagctcttcaattgtatgacctcaggaaactattcaaaaaccccatcctaaatataacgttttaaatttaaaatgtgaagtatgtttccctactgtgagcccaactacaattgttggcctttgaggtaatttgtacataatgaaaaggagtgtgtagtatattttaacatggtaatcatataataaagtagtttacctattgttcctaaaacacctcatgattcatttacttttatgggggtatatttcagaagcaagacaaatcagtgggagaccatgaaagtggctgagtggttactgactcacaggcttatctgtcgtctgtccctcccgacccctgccaccatccctcccactgttgccaatgtaccaaattcaaccttaacccacctatgagctcctttccaggttcacagacccagtaactgcctgacattttatggtgcccctacccactgggcccccagatgctgaaacaagagtttggcaaaccaattggttcggttaaaccaatcaggtttgaccaatgaccccactcaggtggccttgacctcatgtcatatgttccattcggttcatgaaagctagtgagagtcatttccaagggctgccaagagaatctaacttatagcaagagtaaagaaaggccacggataaaaccaagacttgcgcttcagaacgcaaaccagaaaatggaagcaacagatcctatctttggaccatgagagtgaagacaagaaaaagtaactgcagagaaatagatgcctgtgattgaagcaattcctcagtaatcgacactaatcagggcaatgttagaatggaataatgtagaattcaatagaaatgtatattacatccatcgggagccagatgacttcatcacagctaatgtattacaatgactagaaaaggaattaatgattcaccatttagttactttcctcccttcccccaacaccttttcttcagctttaacaaactggtctgaagccaactgcgacatcagtttagtaatgactttaagcaccatttacgctgctatcatggcaatttaaattgtcactttctattaaaaggtctacctcagaatggttttaagtgaaagcgttccacactgacagtgcaattaaacaagaaaaaaaatcctttcttggaatgtcagtgcaaacgcattttaaatagtggttcagcagcgccttgctaatttaaactacagtattgctttctactaaagaatagaaactgatttgggcttttttcccctctctgtactgtatgacagtttgaattggcactgtgtcccagtcaaagccctgatgtgccaatggggtccctgaacctaaagtgtatccttcccaagacagacattaaacagaaataatttaccagtgtgaaggggaagcttcacctttcacagcatttgcttttaaaattgcccttttctgatccaacttgcctttctcaaactgtggtctcacttgtttatcagggagagaatggagaggtatgggggacctactttactgagatgacaactttctgaatcaaaaatggacaatcgggaggccaaggtgggtagatcacatgaggtcaggagttcgagaccagcttaacatggtgaaaccccatctctactaaaaatacaaaattagccaggtgtggtggcgcatgcctgtaatcccagctactcgggaggctgaggcaggagaatcgcttgaacccgggaggcggaggttgcagtgagccgagattgcgccattgcactccagcctgggcagcaagagcgagacactgtctctaaataaataaataaaggacaatcaactagagaaaatttagtgtggaaaagaattctgagtacaggtgtgtgagtctttctctttcagatttctaagtttagatcctgaggcggtttatgcatttcgccaacctccttcaattcagctgagaaaagacccttcaggcactttcatctttgaatacattttaacacagaaacgataagggagcgcaaatgttgaacgtgccagtacaaaataacacgttttatccacctcatttgttttccggactcctgtagacccaatagtccataattcccaggtatttggcttagatagattccagctatcagagagaataacacaattacattcttaggtgtgggtgccttaaattagaagttgaagaatatttgaacagcaggaatggctggcattttcttttaatggtcttgaagcgtttccagcctgacagaaccttatgtcatgagcaatagctctgaagcacactaggctcaccagaagtaaacgaggcataacatttaagttgcttctgttacattctcaattgatatcgttattgctctgaaggacaccgagacagcatcttgagaaaagtgtcccaatgatggttatcgagatgcaattttttatgtctacacaattacatttctaacttcgccatattccacactcgactgccgtggaaaagatgatcgatgtaaacccagtcctcacaagaataatacataagccaccaggatcgaaactcatttttattttacaaattaggcaaactttctttcagttccattttcttccgttaatataacacattagtatttaagcccagggcagctagaaacagaagaaatgacctgctgatttgggggctgacaggggccaggaaagggtcacctcagaaagaagtattccttcctttttttcttttttgtattttctggtagagatggagtttcaccatgttgcccaggctggtctcgaactcctgggctcaggtgatcctcccacctcagtctctcaaagtgctgggattacagtcatgagccactgtacctggccagaagtattccttcttgaaaagtggaggtgaagggaagggagacagacccaaagaaacagtctttcgggcaaggcacatagaggtttgaaataaaggtgctggcagggccaaaagctccagagaagattctttctttgcttctttctagcttctggtggttgccagcaattcttggcattcctcagcattcagttccatcactccaatgtcttcctacatcttcacatggtcagcatccctctgtatgtgtctgtgtctcctcttcttgtaaaataccagtcatattggatttaatgccacccctccccaacccagtatcacctcattttaactgattt

SEQ ID NO: 1568 - DNA, 4850 bp, artificial
  synthetic oligo
tcaacagcaatgacaacaaaaggagtaacttaagcaaaacaatgcccctttaggaaatcacttcctgtttctaaataaaaatcggtggattgtgcttctgtgtaaagtgtgtattttaaaatgtaaaataccaaaacatgagaaaaaaaacaaaactcaagtaaaaactgggaattcatgtgggtcagtgctcccatgcttttaaaagagaacaaactaccacaagcctcagggagctggaggggttggcttgcctcccttcctctgacctaccaactggctccctgcttgcacacctggatgtggctgcactatctgaacagcgcctgttgccaaaaacactggctgctgcaggactctcaaaggctgtgtctggagctggatctgctgtggctgtggttgtggctgcagcagcagcagcggctgtggctgctgccccaagacaaaggggagctggacaccctgctgaggaacctgggcagagccaagcagactcaacacagcagcctggggctggggctgcagaccactacctgctccagtgaggttcacattaagaagttgctgagcagggaaggcctgcccttgcgtgctcaaacctagtgtggaaccctgtggccctggctgaggagggtgagcagctgtgggctgctggagctgctgcagggaaaccagctgatgggactgctgctgcgggccggtcagaaccgcccagccctgcggaacctggagtgtcagaggcctgagaccttccggagtatttaggaaaaactgaaggggtgctggagaagatgcctgcactgcaccgggccttgcatctggtagtggacctcctgaggactgaaggccactgccactgattcctgcaggagcgggggcacccgagccaggggcctgcacaggcttgaaactgcaccccaaaacctgggctccccggactgggccctccacgttggtggcctttaggccagtggagcctgtccggacctgaatggctggggctatttttacgaatctggtggggcgcccggcagctggacggcgcctgctagctttaataagaggcacagagggcttctgagaatggcttggtgccgccccaccggccgccgccgccacagcagcagcagctaaagcaggagcagcagcaggagcaggagcaggagcaggagcagcagcagctacagcaggagcagcagcaggaaatggacgcttaagagggctgcctgcctgttgtgggggaaaactgttacctgaggaaatctttcctgagcttgagggaagttgggtgcggggaggtggatgtttctctcccttcccggatactgaagactggacccacacaggatcaggctgttctggtgttttccatgaagagagctgactgacactggctgggccactggagctgtgtgacatcttgcctggacctttgactttgctctgcaccgattcctgggcctgactcactgccctcccagcatcagtctctgacccaggcctgagacaagctgaatggtcatctgggaagggctgccagggagacttctggctcttctgcctggcttttttacgtggccgtattttaccacagagaagcggatcattaaacgactgcatgatgtttggcttggtgtcccaggcctgacagccagcttcccatgcatgtctgaaagggtcttctacctcctgggctggccagactgggagctgtgggtcagcagctgtgacggactgataccctttagcaagtttctccacatccacttctgaaggcacggccaaatcacagggtctgcctttccacgtgtctacacaacttcccgctttagtaatgttcagctcacaaggctgacctacttttctttcttctttttggccagaagtcgacactctcagctcaggaggaggtggacagtcagactgctcctgctgtggctttacagagggccacgaatacctctggaggcactgttccatcgggtcggtattcatcttttgcttgttgtacagcagcctgtttgcagtgcaggcaactgctacagaaggatcaagacacagtggttcagctgtcgctaagatcagttgactctcaagaggaaatttgtcttcctggctccatttctcgccatctcttgtcatcgtcttcacctcaggggctaaagtctgcatggttggacgtagaagaatatgcctgctttggtaaccaggaggttgcatattactggactgcctgtagtcacgaacttctactatgacacacccactatgaaaaatgttaaccgaagctttatccaggacatcacccaaagcagggggtaattcttctgcatccaagtagtccagcaatgccctttcttcataaggcagccgaatggtctctgcaaaggacccatcttctctctggagcatcacagaatacccctgattgcctgggtatagattgaccagtaaacatggcaaggactctctcctaacaagcttttctaacaagtttacattgcttctcaattcctgaggatcctcaggctcttttccacattcttcaacataaatgtcataaagtttttcctgcagagtttttcccgccctaggtgagtatctccttctaggacgtctctgttgggcaatttcagtgatattctctgtgcgatccagagcctgttctaaatctcgatccattgtaacagaaaacagggcccctaagaggagagaaaacgcatgtgcgttggtgaagcagggtggaatcacggctgtcatattaatctacaggcccgcaagacgccgcaagtccacactgagttcaacacgggcacctgcccagaaacccgcccccagggaagcgctacccaatctgtttgagggtttctgaaaacatgggtacctgaggggtcgtcgtcgtggccgggcttcacgtctctgcggcctggaacagaagtgagcgggagggccggggtcagcttctaggcgcgtctgggcacctgcccagaaacctgcccccagggaagcgctacccaatctgtttgagggtttctgaaaacatcggtacctgaggggtcgtcgtcgtggcccgggcttcacgtctctgcggcctggaacagaagtgagcgggagggccgtggtcagcttctaggcgcgtctgggcacctgcccagaaacctgcccccagggaagcgctacccaatctgtttgagggtttctgaaaacatcggtacctgaggggtcgtcgtcgtggtcggacttcgcgtctctgcggcctggaacggaagtgagcgggagggccggggtcagcttctaggcgcgtctgggcacctgcccagaaacctgcccccagggaagcgctacccaatctgtttgagggtttctgaaaacatcggtacctgaggggtgattgtcgtggcctgggcttcgcgtctctgagtgctgcaccggaaatgaacgggagggccggggtcagctactgcgcgccgtctgcgcgtctgcgcgcgtgcgcacttgccgcacaccgcagattccaggcgccccctgcttctctggcttcctgggcgcgaggctcactcgctgcacttccgggtctgctgcccgcgccggcactcgactacttgccatttcaccttgaaagcgtacatgcaaaagcacgagccactaaggacagtataaacacatctttcgtaccgcgcatagacatcagtttccacaggaataccactgtcgggaaatcatgggaagttgtcactggtcttggcggaaacttcaacaattgttggcacttttggaatctcttgccatcagtggcagcactgctgctggtatcagccactgggctgtggaatgagcccgcattagcagtgcttccatgcctggagacgccacaggcttgtggcaagcgtcagggttcttcatgttgtcgtccagtaagctcccgcctgggggtgttcatgtggatgccccagtacatgacgttcatttacataattactcaccttttatttctccatgtgttgagttagggcacctacagattaaaaaattacctggtgggtcattacattgtctatggattgcaggtcaggatggtagagagacatgaaaccattcatttctacaaggtgatttgcacctgataaggacgagaacaattgtccaggtgatggcaataaattttcaatgattagagtaaactgtagaccttagctaagatcctaaagatggatttgcagcaatatcattcagtcttaggtaatttatgggacattgttttccattaactttgttgccttgaaatctcccagtttgtttgtttttgtttgttttattggacaagatcaataatgcttttctggggagatctactccatagcctgtttttctgactcatgagtgtgatctaaattctgcccctccctccgctgatatcccagggtgcatcacacttattagcgaggtatagctgcccgccctgccatgggatggactcgatcttcagctggtgaattgcctgtgtcttcacttgggtttccccaaaagcattcccggaggagaggatttgagtcggagtagtttctttgggtgctaatccttaggagcattggtgacagaaaggggagctgagtcagagatgggaaaacagacaatgaaagatgtattcctgagcacgagcagctccgaacaacgggtccacgctggggaccttggaagacagtacagaataagcctcagattgttcttccctagaggcaaagaagctggggtatttattcatccacttctttctcattgacttaggacagtgctgggagcattatttcctgacacttctggttgccacatacaggggccacccatgctga

SEQ ID NO: 1569 - DNA, 5300 bp, artificial
  synthetic oligo
gcagaatttagatcacactcatgagtcagaaaaacaggctatggagtagttctccccagaaaaacattattgatcttgtccaataaaacaaacaaaaccaaacaaactgggagatttcaaggcaacaaagttaatggaaaacaatgtcccataaattacctaagactgaatgatattgctgcaaatccatctttaggatcttagctaaggtctacagtttactctaatcattgaaaatttattgccatcacctggaacaattgttctcgtccttatcaggtgcaaatcaccttgtagaaatgaatggtttcatgtctctctaccatcctgacctgcaatccatagacaatgtaatgacccaccacgtaattttttaatctgtaagtgccctaactcaacacatggagaaataaaggtgagtaattatgtaaatgaacgtcaggtactgatgcatctacatgaacacccccaggcgggagctcactcgacgacgacaggaagaatcctgatgcttgccacaaatctgtggcgtctctgggcatggaagcactgctaccgcgggctcattccgcagcccagtggctgacagataccaacagcagccttgcaactgatggcaagagattccaaaagtgccaacaattgttgaagtttccaccaagatcagtgacaacttcccatgatttcccgacagcggcattcctgtggaaactgatgtctatgcacggtgcgaaagatacatctataccgtcattggtggcttatgcttttgcatgtatgctttcaaggtgaaatggcaagtagtcgagtgcaagtgcgggcagcagacccggaagtgcggtgggtgagccttgcgcccaggaggctagagatgcaggagccccagaacctgcggtgcagcgagtgcacatgcgcatagacggggcccaggagctgaccctggccctcccgttcgcttccggtgtagcatgcagagacgtgaagcccgggccacgacgacgacccctcaggtaccgatgttttcagaaaccctcaaacagattgggtagcgcttccctgggggcaggtttctgggcaggtgcccagacgcgcctagaagctgaccccggccctcccgctcacttccgttccaggccgcagagacgcgaagtccggccacgacgacgacccctcaggtacccatgttttcagaaaccctcaaacagattgggtagcgcttccctgggggcgggtttctgggcagatgcccacgttgaactcagtgtggacttgtggcatcttgcgggcctgtagattaatatgacagccgtgattccaccctgcttcaccaacgcacatgcgttttctctcctcttaggggccctgttttctgttacaatggatcgagatttagaacaggctctggatcgcgcagagaatatcattgaaattgcccaacagagacctcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaacgatgcagactttagcccatgatgtgaagatgatgacaagagatggccagaaatggagccaggaagacaagcttcagcttgagagccagctgatcttagcgacagctgaaccactgtgtcttgatccttctgtagcagttgcctgcactgcaaacaggctgctgtacaacaagcaaaagatgaataccgacccgatgaaacggtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattgctaaagcaggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagacccttttggatttgcgttggaagctggctgtcaggcctgggacaccaagccaagcatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggcccaggaatcggtgcagagcaaagtcaaaggtccaggcaagatgtcacacagctccagtggcccagccagtgtcagtcagctctcttcatggaaaacaccagaacagcctgatcctgtgtgggtccagtcttcagtatcggggaagggagagaaacatccacctccccgcacccaacttccctcaagctcaggaaagatttcctcaggtaacagttttcccccacaacaggcaggcagccctcttaagcgtccattttctgctgctgctgctattgctgctgctgctgctgctgctgctgctgctgctgctgctgctgctgctgctgctcctgctcctgctctagctgctgctgctgctcctgctctagctgctgctgctgctcctgctctagctgctgctgctgctcctgctcctgctcctgccgctgctcctgctgtagctgctgctcctgctgctgctgcttctgcggcaccaagtcattctcagaagccctctgtgcctctcattcaagctagcaggccctgtccagctgcccagccccccaccaaattcataaaaatagcgccagccattcagttgaggacaggctccactggcctaaaggccatcaatgtggagggcccagtccagggagcccaggctttggggagcagtttcaagcctgtgcaggcccctggctcgggtgcccccgctcctgcaggaatcagtggcagtgaccttcagtcctcaggaggtccactaccagatgcaaggcccggtgcagtgcaggcatcttctccagcaccccttcagtttttcctaaatactccggaaggtctcaggcctctgacactcctccaggttccgcagggctcggcggttctgaccggcccgcagcagcagtcccatcagctggtttccctgcagcagctccagcagcccacagctgctcatcctcctcagccagggccacagggttccgcactaggtttgagcacgcaagggcaggccttccctgctcagcaacttcttaaggtgaaccccactagagccagaagtggtctgcagccccagccccagcctgctgtgttgagtctgcttggctctgcccaggttcctcagcagggtgtccagctcccctctgtcttgaggcagcagcagccacagccacagccgccgaagctgcaactgcaaccgcagtggcagccaaagccacggcaggagcagccacagtcgcagcagcagcagccgcagcatatccagctccagactcagcagttgagagtcttgcagcagccgcagcatatccagctccagactcagcagttgagagtcctgcagcagccagtgtttttggcaacaggcgctgttcagatagtgcagccacatccaggtgtgcaagtagggagccagttggtagatcagaggaaggaaggcaagccaacccctccagcgccctgaggcttgtggtagtttgtctctcttttaaaagcacaggagcattgactcaaatgatttcccagtttttacttgagttttgttttttttttcatgtttcggtattttacattttaaagtacacagtttacacagaagcacaatccactgatttttctttagaaacggaagtgatttcctaaaggagcgttgttttgcttaagttactctttttgttgtcattgctgctgtcgatataattatttttaatatagtgttttaaagtgtccaaatcccaaccagtttgagtctaaactcgtgaaacgtataatttctctaaagccgtaaaatggcaataccaacaatattaagttaatattttaacaagattttaattttaagttaatattttaacaagaagagtgggattaaatttattttaatggtggtaaaaacatataatctaaaatggaccaccttcactattttaagtgcccagtgcaatagtattaagtccatccccacggttgtgccgcagatctcgagaccatcttgcaacactgaaactcatgcccattgaacagcagctccccattctcccttgcccagtccctggcagccattgttctactttctttctctatgagttgactaccctggccacttcatggaagtggaatcatatggcatttgtcatttgatgagtgtcttatctcacttggcataatgtcctcatgatctatccctgctgtctcatgtgacataaaggtcattgctttttaaaaatggtttccctgtacataatatatatgaaagtgacttatgaattctgagaaacctctttcagaagaattctgaaagagtgtaatcgtatttagattaataggtttatgtacaatatatggaatggaattattacacattcattttgaaaaatgaaatgaaaaagtacaatacagtgatccttgtcacactgcgattgaatacatggaagacctctaaagctgtggaatggaattagtggcagatttgcttgtgacagtcccctgccctttcaaaggccctgtctgcacctagtgctccacagagcaaggctttctcactggctttgaaaaggctctttttggatgttttgtgtgctctctttataaaatcatttacattttttgtaggttgtttgcaagaaacatttagtgaaacatttgaaaatccattttattggtttgcttttcaaatatctgtagccttgtttcttaagtagaacccccgtctttttctttgtc

SEQ ID NO: 1570 - DNA, 2000 bp, artificial
  synthetic oligo
gtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccagcacctttcgtttctcttctccattggtgtcccacccacattctccctgtccggtgggctggtgggcggctttcacggattgaggtgggaccaaagaagattcgggttcccagcctgcctcaggcctagctgagatgggaatagattccaccaccttctgttaactgaatcatgtttccccagaaaacgaaggagctggttgtgaaacacctaaaagtaaaacgcatgcattgaggtatcagaatggaactcagcatccctggaggaaaatcaaatccagcagcaaagatgttctaagctctccaggggaaatcgtagggtgtctgttcatttaatgaattttatgtaaatgtcaagggtgtcagtgatagtgtcagttgggcataaaaactaaagtgcagagtaggtagaacatttgaggaagacctgatatgcaaaaagtgatgtccatacttttttttttttaaaagctaggataggaagagaggaataggttaaagttgagaccaaattaaaattttagaagccaatttgccagagaatgatgatgaaagtcaaagttcaatgacacgttgatttctgcatcttcaaacttcactcccaaaagctattggtagttttacttactatctcgagaattgtagaggtttgaggcagtttctgactttagagtttagaaaatgttgctattgctataaatataggcaagttttccatctttatggtttagggaagattctgaaggtatcagcctttcattagtgtaaactgaaacaggataattcacaataaaaggaacaaaaggaatccagaaactcccagttctttccaccctcaaagtttaagtgatagctccaatagccagccaaaattttggttagttgatttccatagcagctagtgtctacccgtgttaataggtattttggtaaggatgttatgtgagtaggaaaaccacagtggaggatagtgttatcatggaaaacctgtgaggccagtatctggaaacaaatgttctaattctggctctgccactagctcagaatgtggccttgactaagtgaccaaacctcacttggggttcattttcctcattaataaaatgagtagattgtatcaggcgatctttaaaagcacagctcaccactatacgattgtgatttcaaaggaagaggcatgaactttctaaaagaaaactaccaaatc

SEQ ID NO: 1571 - DNA, 1350 bp, artificial
  synthetic oligo
ctggcaaaggctttactggtgatagccagatcaaaataaaaacatgtttatacatatttatgcttctgaaaattaaccacactggtacattagtggttgttccagtcctgagagatcctgcaactcttttataaaatatttgaatcaattcagaagatccaagagaggcagaggagaaagatgtagatgagctggaccaaaagaaccacccctcccccccaccaaattctttagagtctgcaacttaagctgttgcttttgttaatcagtagctaatgacatttacagtagcagtattacaggcacaaggcatttgagctaaaatttcatttcttccaatgcgtgaaacactaaattgaacacctgaaaaatcagttatgctgatttgcttccaaaaattagaatgttactgatgtaacgctttaaggttgaaatgggcattcaattgtgaactttctcttcagcagctgtggctttttcagaatttctttttaaccaatatttcttctacttttttcagccaaatgattaatttttgtgggaagcatgcatcctttcagtttttctgccttctttagagaaaaggtgctctataaatgcagactgataaataggatttaaagtgcacaaatcagcctctgcatagcctcattacatgcgataaaaacattcctctgggttgagttgaataatttaaataccgtaaagcgaaaaaaaaaaaaaaagaggaagaagaagaaggaaagaaaaataaatatttagcatgttggatgaggctaaaactaggtgaaaaacaaagtgtcaggaaatttttccttgatttgagcacgtttagctaagctctttagagggaaaaatgccataaaaatccaactaatatttgccccaaaaaagggttgttgggtataagtcatcttgcgcttctttctctttaaaaattgtggtttgtgattcggcagtatgattaataaaaagatcttattattttagaactcaatgagagcgacagttgaactctatgaagacagaaaagagggctaccctgctgttaaaaccctcgttactttgggtaaagaagacttatccattaaggtaactgttttatgtgcatgtatactttaattatcagttgtgatttaatagtatctagacattgaaaaatcagagggaaggaaattgacatttattgagtgtcctgtttgtaagttctatgctagatccttggcttaagttaccttatttaaacttcattagaaccttgttattcagggagttgaacaagacctcaacaccaagcctgttggatcccactgtaccattcggcctcctttgttttacactgttcacaaa

SEQ ID NO: 1572 - DNA, 19000 bp, artificial
  synthetic oligo
gagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctggaaataactgaattttcttgaagcccttacaacctctggtttaaaaaaaaaaagttaaagacgaagcttttacaaatgtaaaaaattcccagttcaaatcgatccataacttacttcttttgcaccgagtgtgtcaatctgaactcatcaatcagaaaaacagaaatcgtgcttctaaagacctgcaggattttaaagttataccaaggccaccaaaacacttactaggtagggcctagaaaggaagaatccaaaaatagtagcgacaacagctcccagagtcccttattttgcgatgtgtcttgctaattgggaagttcaacacgaggctttccctgcccatacaaggctggtatttcagagcgggaggagcagatggaaggggtcctgtgggaagggaggtgtgggtgtccctgtgtttaattaagagttgtattgtgtggaagggaggaggaaagatgccgggctgcacagccctctgttcccttcatcgcaaaataacctgcaagtgaaaaaaaaaaagaaagaaagaaagaaaaagaaaaaaaaaaaaaagcccgctactaagacggagccggctctggaatagataccattagaaccacagtgtttctggaataaagatatctaatttcctgccgcaaatcacttccccgatcagaaaacacaaatagctgaacagaagggggaaaaaatagaggactcctccaaacccggggcagtgctatcctcctcccaaccacccccactctgctcccgactttccagcccacccgggatcccttttgaggacacccagcatctttgagggaagggagacggctcccaggctgaggttgggacagcgacggtggcggagaactggggcactcacggcctaggggcctcgtggggccgctgaggccgggcctgttcggcaccgacggcgtcacctcctcttctaaccggtcaccccgggcagggccctcctcagggcaccgcttgcccgaggcggcctcggtttccctgtctggaaggaggtgcaggagcccgggggcaggggagctccgggcgccctgctggggccgcgctacttgggggcgttgcggcggcggccccgacgccccttgtcaaatcgcctccagggtctcggggacccggtgaacaaagccaagacccgacccccggtggccccaatggcgcgggtgaatgaggacgctggacttaggggcgcccgcgagagggcgcaggctgggagggcctgggaggagaggcgccgggctccgcgtggggctcgtgaccgaggggcccccaggacgcacagactcgatcgcgcctcgaaaatgaccgtggtggtagcaggtgcaggcggagagtggaggcagaaggagtgggaggaggagagcaaatacatctactcagatgctaatgcacagaaagtgagccttagctgttttttctttggagattaaatgaaatctcaaacggatttgtttttgagtaggaaattgtagatttctcacaatcgcatgaaattttgtgttgcacgcctctaatcaacatcacattctttgcccccactttaggctttgcaggtcttagtacagttctggtacccaggaacatctttcccgaaccagaaaattgcactgtggctgtgggagtgtagtaggtacttttatttgggcaaatggcacttgatgtttcatcctcatgaggtgggcgctgattgatcttttcccttatttaaccaggcctcattcttttccctcaattctcccattactgctgttggggccatttcattgttcattactcctacggtttaaggcttgcaagggactaaaaagaaattaaaagcaacgtattttgcttagagaatcccagaaaggctggaaagaaaggcgattgaaacccacggttcaagtgaagtttagacataggagtgatttttacatatttctttttcatggataatagggagttggcgttatctgtcactgtacgttctacctaataaatagctgcaagactataatctaacaggtgtaaaatttcccttttctgacaaatgaagagaccaccaacactatcttaaacagtacaaatagaaaatgctgttgttgacaatctttcacactatggagtcaattctaagctagcttgctttctctttcttttctctttctttctttctttctctctttctttcttcttccttccttcctttcttccttccttccttccttgcttgcttccttccttccttccttcctcatgcaggcctggcttttggggtgtgtaccccacacagagagttataaacaaagataggctgatttaatttctgccctcccccccaacacaacctgcaaaaatatcgaggaggggctttttactctctgccaactgcaaaagggactgatcatcagagaaaatgcctgtcctttctttcactcatttctcttgatctcctccaaaaatatggcctatttagttattaggcatcacagattgggaaaagaaaaagaagcagagagggctgtcccaaggctccattccctaggaggtcccacttccatctggcatatgttgagtcctcctgttttcctctcaaagggagccttgtttatggaggttttctctgcattcatttgttcccagccatctcttcaacagctgtccccccaccttcccaggatcccattggtcaggcttcgctcccactgcatggaatgcaaaaatatctcacccagaaatgtcttgtcaaagacagagagggaaaccggcccaggcaatgctgcccttgcatgtcatcatggaccaattcttacctgtttctcctcaccctctttctctcttcttcagcttctgggttgaagcattttgatgttatttatacgaaggaaatgacattagagtaacctttttattgcattacactaaaaggagattgaactataactttgaaaattgtgacattccaatgagagctatattaaattgcttaaaaacatttcgaaggcatcattggtattgtctgtagtggtaagtgaaacaaaggatttcacagcatgtcgggtttaatacaaactatgctcacatttaagtctttaagctattaaatagaagagaggagaaaggggatggtgaaatagtatcagagggggatggaagagagagacagaagatgcctaagagaagacaatcctgagaataaaaggtggcacagactgagtgcttactctttgccagtacttaaaatgtgtttcctggccaggtgtggtggctcaggcctgtaatcccagcactttgggaggccaaggtgggcggatcacttgaggtcaggagtttgagaccagcctggtcaacatggtgaaaccttgtctctactaaaaatacaaaaaaatgagccaggcattgtggcacgcacctgtaatcccagctactcaggaggctgaggtgggagaattgcttgaacccaggaggcagacgttgcagtgagctgagatcgtgccactgcactccagcttgggtgatacagcaagactctatctcaaaaaaaaaaatgtttccttcatataaagaacaccaaaatgctagacggctgctctaagtgcttttcacacggatcaacgaatcctccagacaatcatatagcgatggttctattagaatccctcttttacagatgagaaaaccgaggcacagagagggtgtccaattcagcctggttttcccaggatttgcctgggtttccaggtgaaagtcctgtatcctgggaaatccctcaatcccaggcaaactgcgatggttgctcacctgaggcacagggagaagtagtttgcccaaggtcggagaggtggagccaggatgggaatgagctaggcagtctgactctggaatctgctgctcttatcctctgtaaatctcacccatttttacagaatgagtaacttggggcattagagagagatgaactgacttgtccacagtcacagagcttgctagtagtgggtggatgactaaaatttgggactaacaaatcacacctcctttctactttcagctaccttctgaaagaggttttgtagaaaagaaagcagctttaaaaaaatcttagaagtaaggagctaaataaataaacacatccaagaaaaagacatctaccatattgagaaacatcacgacctggcagtattagaatatgtagcaaaaggaggtcacctatattgtaaacacaatttataatgaaagacaatttcaaaattgcaataagtacacaaagaaaataattatatggcacatgtggccattaggcagggaacattttaactccctaaagcatttggtgtattgttctgattccattattgttcactaatgatggtcattgttccacctcacgtcatcctcaaaactggcagccccctgcagtggacattgtttccaaacagcttctctaggacctttcggacaaacctgcaagaactgatgatgttctgcgcatggagttggtaagcaggttgtagctgggcattggccgggaaagaaggcattctcacttggaacacagctcattgtaaaaatgcagtttgacatcaataaaaataatcactatttgttgtatttcttataattataggtcatctcttggtgaggctctgcagttcgtaaagtggcgatttggcctctgtcatgctgatgctggaggcagccaggccccagagcctctcctggcgggcatcctgaatgccagaagcttaggcacaacttcagggaagaaaacattttggaaatgacgagaaaactgtgagggagttgcaactgtaaacagcaaatgtgctaaagaccagagacttatgcagagctaaaagagggcaggtggagctgttctcagttttttacatgtgaagaaaacattgggctgactccattctggttccgcagagctaaaatgtgccttgatgactgttgttgttttatttaacacaagcacccggggctgcgtgaggatcagggcttgatgagccaaaggattctgagaaaaaaggtgaacagctgtggttcttgtcaaacacaaactcttaatcgttgcttaatcattcccccatattagacatttgtgttattttaattgtttgctatcgcaaatagcattgtaatgaaaacctttgggcacctaacttattcttttgcattatttcctttacataatttcctgagagtgggattactgattaaagcgtatgaacattttagtctcttgaaatattgccaaaatgtctccaactggttgaaccaattgacactacctttacatgaatgtaccaattttgctacaaccttgccagcattatgtattacagcttccccctgccacccccgcctcaaaatatggtgatttaaaaaactctatacttgactctagttctcctaactctatgctcggtatcttccccctcactccagcatctctatctcttgcctgtctgaatggcttgaactaagacgacaagaatacatgagaagaaaggtaatcctggccgggcacggtggctcacacctgtaaggcgggtggatcacctgaggtcaggagttcgagaccagcctggttaacatggtgaaaccccatctc

SEQ ID NO: 1573 - DNA, 1750 bp, artificial
  synthetic oligo
tctgaagtagctgggactacaggcacatgccaccacccccagctaattctttgtatttttgtagagacggggtttcgccatgttgcccaggctgttcttaaactcctgagctcaagcgatctcccctcctccgcctcccaaagtgttgggattacaggcatgagccactgcacctggcagagcttattatttttatgtgcgtttctttcattattagtgaggtcaagtattttttcatgtgacaattggccaattgtattgcctcttccatgactcatcggttctcaattgcttactaatgtgcaaattattttacccacgggtgctatgtcttaaaagtttgctagagctttataaaaagctggcatgagaatcactgtgagattatcgttagttttactctgatttcctttagcttctaagcataatggccagtgtttattttcatgcgttttcatgagtttatttcacaagctgaaagaccacatttcttggcctccctttcaggaaggagtggccaatttaactaaattctggagaaggacgcgttttgtgtggtgtttccaggaagtcatcttaaaagagaggagttttatagaccaatgtccctctcttagtcttctagatggtttgtcttgaagggatgtgagacaaagactgctaattgcatccaaatatccattcttttggtggtgggttaaagagactgcaaattttgtgtcactcccggctgctgctggtactggggcccgaggagggatatgcccgagtggggccgcctgaccaagggagcgacaaacatgacacccgccgacgcctcagccgcttggggcctgcacggaccctctgcttcagtgcagaatgaaccaaggagactcaaacccagcagctactccgcatgcggcagaagacattcaaggagatgacagatggatgtgtcagcacaacagatttgttttggactgtaaagacaaacagcctgatgtaccatttgcgggaggctccgtggtgcagttactgcagccatatgagatatggcgagagcttttttccccacttcatgcactgaattttggaactgggggagatacaacaagacatgttttgtggagactaaagagcggagaactggggaatactaagcctaaggtcattgttttctggctaggaagaaacaaccatgaaaatatggcagaagaggtagcaggtggtatggcggccatcgtacaacttatcaacacaaggcagccacaggccaaaatcattgtatttgatctgttacctcaaggtgagaaacccaaccctttgaggcaaaagaacgccaaggtgaacccactcgtcaagatttcgctgctgaaacttaaccaacgtgcagctcctggatactgacaggggtttcgtgcactccgaccgtgccatctcctgccacgacatgtttgattttctgcatttgacaggaggtggctactcaaaggtctgcaaacccttgaatgaactgatcatgcagttgttggaggaaacacctgaggagaaacaaaccaccattgcctgactggctcccatgagtgtcaatagcatctcagcttcctcagatcagttatatcaccagcactccagaatccttctctttcttaaggcactttgcattgaagaatgttcctggatgttcatatctagtgtttgaaggggaggaggggtttaaactggtcctgtacatagaaaatttgtttgacagaggagaaaaattagc

SEQ ID NO: 1574 - DNA, 2000 bp, artificial
  synthetic oligo
ttatattcagtttctatattatcacaaaatatagagaacaatctgaaatataatgcattcgcttctatgtaattctcagattttaccacgtcagtgtgcacattggctagttcagctaatatgatttttgtggctagattttcttgatgaaggaaagagcattgattgacgttctggggacaccttaatctgagtaactactcagaatgttttcctgtaattgcagctgagccatcagaacattacttccacatgaaatttaaacatcaaaccatattcgttgacagataattgtcttcatagttttatacagttaaatgctagttgtgtttgtcagcaatagggttggaaaaaggaattctatcttaatattaccattatattggaattgtccacatactaaaaaattactgtattaattctctgttaatactatcgagttgcagtggaaaatgctttgcaagctttatgtgcttttttgtttttgtttgtttgagacggagtctcgctctgtcgcccaggctggagtgcagtggtgctatctgagctcactgcaacctccgcctcctgggttcaagaaattctcctgcctcagcctccccagcagctgggactaaaggcacgtaccaccacacccaattaatttttgtatttttggtagagacggggtttcaccatattggccaggctggtctggaactcctgacctcgtgatccacctgcgtcagcctctcaaagtgccgggattacaggcatgagccaccgcgcctggctgcaagctttatgttttctctgagttgatcatccataaactagcccgtttctgtcattggaaagtggtatttgagctaccttctttgcaaccaaatttacccagcattttcaagcgaacctctttcttgcttctttcattaatgtcttggcaattgtatacggatttttagtcttagcaaactgaagggctgttttataagaagcctgcacagcactaatgcttctatgaaacaaattgaacattgaacatctacttctgtcggcttttatgtcaatactctttctttcaaggattatttttgtttgtttggtgaacttttcttttagtatgtaattgctgcctacattttgatatatcttactggttcttttagctagaaaatctccacaagcactacaccccgttttaagtactttaccatcagttatggctacaaagttgatctcactatttgaagaaaaatacttctgaataaaactagtataaattattttggccttcattgttcaggatgcacgttggtcacggtcatttagtttactactgctgctgtgggcatacttgacgaaaaaagtccagtgaagtttattttgccgagtgtcattcattcagggttaaaacaaatattctataaaatttgtttctttaatttagttgataatgttaatctctaaaaattaaaacaattataaaaacaaaaattattaaaagaaataaatgcctacattttctttgatttttatacactttgagttacagttgacaaagtaaccctaaaacatgatgtattgtaatgtggtccttctgcagtgcatgacttgtgggcaacttacaccacatgtaactcaccaggcaagtttgacaacatccaaactggtccatgccctattcaatgagacaggtacactgacttaatcttccttggatattgcagcaatatcaaattgttaaaaaagtttccaaacactttctctcgatttcacttatctgaaccagctggtaacaaacaattcacgaaacagcaatgggctggggaccactctttaaaggacaagatttggagtctagaggtatttgatttgaaaactaaattttattacttaccagctatgtgaccatggacaaaacttacaatctccttttctcaaaaatgaagataatattttccatcacaaagagttgttgtaaagatgaaataatgcattcacacatttgttcattgagc

SEQ ID NO: 1575 - DNA, 1050 bp, artificial
  synthetic oligo
caaaatgcgctttgttccacaacttagtgatttattactcatgttgccattcacagatcattgtctcatcactcagacgaagaaatctgaagctttgtaaagaataataaggaaagggaaaaacctaaactcacacaattatgtgaaaataaagaaaaggaaaactaatttgctaacaaacggcattcatcttcgcttaaaaaaaaacgcagaggctcaaagcagcagctcttccctgtggttatatataaaagcagagttgcttaaaaattttcagagattaggtttcatagagaaatatatttatagagaaaacagagatgccaaaatggagccagagagctctagtctggaatctctgcttcttttgtcaggtaactgctccatcaattaacacacgatgtcaggagtcggcaaaccggctcatgggcaaaatccgaccccaccacctgtttttgtaccaccactcaagggctaagaatggttttgacattcgtagatggttgcaaaatgttttttaaaagaatggtatttagtggcatgtgaaaattacataaaattccaaattcagtgtccataaataaggttttattggaacatagccacgcccatgaaaaccagattgtctgtggctggcttcccctgctacaatggcagagttgagtagttgtgagagaccatgtggtctgcaaagcctaaaatgtttattatctggccttttatggaaaaagtttaggaacccctatattatatgattaatgacatatttatacccagaaagaagacatgatgaaatatgtttagaaacaggctgggacttcatgcaacttcatatctgaagaaaaaaaaaattatcctatgcaaatatgcagacatgtttacctccaaacacatacatatgaggcacctacagatgacctgtaatggcagttaatacattttatgaatgcttttgacggaagggtgagttcacatatcacctggagggctactcatgagaggagattagcatttgaaacagatccctggtggcttttctctgtcctcttt

SEQ ID NO: 1576 - DNA, 1150 bp, artificial
  synthetic oligo
acaaaaattagctggatatgatggtgcacgcctgtagtcccagatactcaggagtctgaggcaggagaattgcttgaacccaggaggtggaggttgcagtgagccaagatagcaccactgcactccagcctggcgacagagtgagactgtctcaaaaaaaaaccaaaaaacaaaaacaaaaaacaaaacaaaacaaaaaaaacttaacattctgcttcccttttaattataaatttcatgtttaaattctttctctcttctcgcattttactacatgaagttaaaagaagccatacagcacgctgaatgcttttctgcatagaatttactctgccagatatcttaacttattgctcttaagttttgccttccataaagtcctgggacatggacacaatgccaccaaattctttgtaaccttataatgaagatagtcttttctccagttttcaataccttgatcctcattttcattgaaaacatcatcagaatggcctctactgtccatatttctaaccactaacctctaagaaaatttagactttccttacagctattcttatctcctgagccctatcagaatcatccttaatgttccattcatagcaatgtgagcttttttcagcattcacttcaaaactattcctgcctctactcattacccagttccaaagctacttccacattttcaggtatttgttatggcaacattccacttctctggtaccaatttcttagtctgttttgtgctgctatgagagaatgccacagactgagtaatttataaagaacagaaatgcaacggcttacagttctggagggtaggaagtccaatatcaaggtgctgacatctgtcaagggctttctttctacattatcgcatggcaaaagagagagaagggggctgaacttgcccttttataaagtattaatcccacctatgagggcagagtcctcatggcctagtcacctcttaaaagttccacatcttaatactgttacaatggcattaaaatttctttctttctttttttttttttttgaggcggagtcttgctctgtcacccaggctggagtgcagtggcatgatctcggctcactgcaacctctgcctcccaggttcaagcaattctgcctcagccttccaagt

SEQ ID NO: 1577 - DNA, 1600 bp, artificial
  synthetic oligo
aattactctaattgtaatggcaagcctattaaaatgatctgtcattaaaattgcagtgctgtggcaagtaattttgtctatcaaataattttaatattgtcctaaaatgatactgtttcaatgctctcagtccagttagaatatataaatcatttataacaatgacatttttgtttctgttacactcttcttaataaagttgtatggatttggcttcacaaaattttgactttaaactcttttaagaaagggaaatgaattcatcactctttgcttgtacttttatctgcacattccccgactcttcccagtgcttactccataataggaatttgaaaggggaaaatgtagggggttataggaatactctactccttttggtgctatgttataaaaattgtttttcctttttaattcataattgacaggagaactacaactgtaatgatttcaattctagaatttccattgagttcttttttatagtttgatttctctgctgagattccctgtccttatattcattgtgagagtatttttatttactttcctgggcatagttaaaatagttcctttaatatccttgcctaacagtttagacaattgcgtcatgttagggtttatctccgttgattgccttttctactaaaaataaaatgggccactttttttgttttattgagtaattttgtgttttacccaggatattgtgaatgttatgttgtggagactgtagattctgttataccctcctgaagagttgatttcgatgtggttttgtcggcttgtttttttaatcaggcacaacatttggttggtctcaaagtgcgtggtccattttctgaagcagcaacagttcaaatttcagtttatttagatttagccgtgttaacttgagcctacctggcacatttgtggttcagccacagaaatgaagaaagtttatagagagaacttggcacactccccctctgtctccttttccgtgtcactccctcactttccctttcctgtggtttcccggaactctgtcctctgaatcttcaggccaggaatactacaagttttctatcagagtttcaaccactccgtgtagagccacctttgttttgtcctaacgctaaatggtaaaaaactaaccctatcccctgttctttcattcaagtttcgagtctccttttggatattttcttccaaaattttgttttgttttgttttccgtggcagggttggatctggtagagctactcagctatactattaataatagccaaactctacagctctatgtgatttcaaatattacaattgtaaaataaactttgtgactgtaaaagtttctgtgctgtttttgctagttgctagtcagatgttataataaaataatttaaatcattaatacagctaataaaggtgagcctaccaaatacagcctttctataagctatttaaagttttgaaatagaatttttcagaagaccataaaacaaaaataggaagtaaatggaaaaataattacttggtaattcacattataaattaaggatatctgagagacgaataagtggcattacagaagccataaggtgagaagtaaatg

SEQ ID NO: 1578 - DNA, 1300 bp, artificial
  synthetic oligo
tggattgctgggaatatgtagagatggagttctttatcattaagtttcatttgagcaacatactttaacataccgtttcagaagccatgctgggctcagaaagagcacgatgaaatgagcttatgaaaatcaagttttctccttccccattcatcttagtacattatcagcacttggtccagatttgaccttaggtggtttactctggatgattctggctgtaatgtatgaattaggcttgattttcactttcatcagctacagctgcctttgcagaagtgaggacagtaaagaaacttatgagaataaaatgaccattgggatgctgaaagacagcatttcagagatttccaatgcattttgctttatttccttttttaaaaaagggagtatatatatatatttttttttccttgatagataattagaacttaaatgtgttgtctggtcactttattacaatctgtttcacaaggcaaaaaggaaagttctcctggcaccagcaggtcctcattagcacataagcaaagcattcacctttatatctagggtgtgaatacccgacttcatcgtcttctagtggtgagtctcccgatcctacaataaaaaagaacagaaactgcagcaagaaaagccacatagtatggacgcatatttcaaagcattcctttgccacagaccatgcaggaggtgctattagaatgcagagccaagagcaaaagcttctgtggccattcatgaaggaacaaacaggagatctctcagagtgaaaccggctgagctgagattgccaaaaaccaagcaaaatgagcctcaaactgttttggaatcaccatatgccaagtgaaattctggaatagggaaacagagagagtcaacttcactctgagaagatgccaatgtatatgaatctcatgccaggggagatgcaataaaatgtgtgcatcagacacagtccacagtttccccagcagtcaaagaaaacccagtagaactgggtgtttatggtacctgaaaacaggtccatcttgtgaaataaatttaaatgcaagataaggaggtaaatcaaatgtcttatcttgacaaaagaaacacaaagttgcttctatatacagcatttgtaggaaatgaaggctgaaatagactatctgtgtgcttatttagaacctctcatgaacgtatggctcaagtaaaatttctttttttttttttttttttgagacggagtctcactctgttgctaggctggagtgcaatggtgtgattttggctcaccgcaacctccgcctcttgggttcaa

SEQ ID NO: 1579 - DNA, 2300 bp, artificial
  synthetic oligo
gaacggagggaggtcggatggaaaaggagaaggggtccccagcttgagaaaggctcaactaaaagttgaggttcccaggcagctcacaggcacctcccaactcagtgcggaaaagctacctctagcttctcaccttatttgcccgctcccagaaagctgcttctgggacgcttaatgacttcctcttcccctacaggttcattttaacctgattcctgctaaagggggtgggagaggaggtattaacacaccatgggaataacagttgcctggcagtaaggataaaatttcctttccactttaccctgaatcagttcctacaaagcagcttaaaacttaagagtcagctcaaaacacaaatgttcctgtttattaatttacaaatttgttctattcattcatttatttaggtgcgtgcagagaatttcccgcagccatccctacatctcccaagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgctaacctaagactccagggtgaggaagttagctggagctttttaaagtgcatctccaaagagaattttgctcacaccatgagagcccccaagaaacaccagggcccccttagatgccggagaccacgccctccaggaataagccgcaccctctgcccagcagatccttgcgcgagtagccctctttccctggggctaatcaagtgcatgccacatgtcaccactctcagctggcaattcttcctcagaggcgcagactttctcggaatccccagcagggggggttaagagattcaggggaggccccgcccgtgccttccacaaaagtcgctttaccgtggctcgtgtcctgcggccccaagggggtagcctgggacgtgtagtgggagggcatagaggctccttccaggacaagctgccagcctccagtgggcaaccatgtgagaggcaaaattctgggggtgagaaagtagcaaactagtctgcggccaaactttctctgtggagcctcctacaccgaaaagggtttgattggaactctggaagcccggacgcagaaggtgctagggctcccgtcgccgcgagggcgccccgcgcctggagatgggatggtcagttcttcccggcgcgtgcccagacaccagccccgatccgcatcatccccaccctcgggctgcgaaagaggagttctgcgcaaacaaagggcgcccccggcacctccctctatcccgagcgaagggtcccaacggcgactccgggggtctttggtgcccagctgaggaggcagccacgcctccgatcctacctgggaagctgcggctgggcgggacgcgcagcagcagcagcagcagcagaggcggcagcagcagcagcagcgcgggccgatgtgcggggctccccatggcgagcgggcgcttagctcgcctcggcagcgcagcgcgcttcccgggggcggcaggagaccgaagagaccaagggactgcgtgctagcgggcgggcgaaggccgggctggaaaactcctcctctcgcctctttccctccctccttcctgcctggggcctgccctcctttctccgccccccctggaacactgcgcggttcggggctctgacccacccacctcctccttttgtgccagcgctttttctggccagagagcgctggagacaagccccagcagagcgaaatatcctgaagtagctttctttgccccaatttgcgcgccccctcacccggaatacacacacggtattcaatacaaccgcctcgaacatcccagacgtctagaaggataccatctgtgcagaaagctgcgtgagtcacacggaaacagaaggggcaaccgaggggattcagagtggcccactgcggccggatactatggccatgttctctgttttgatcctcacgaccatgccccaagttcgctattaccatgtccactttctccaataagacaccgacgcttagaaacttgcccagattcacccccgttactggcagagcagggactggaacttaggtgtgtagttctgccgacgtcaaagtccatactacagattttttgttagtttgtttctcttttgcaaaggaataaatcaaggac

SEQ ID NO: 1580 - DNA, 1600 bp, artificial
  synthetic oligo
gataacagcattagacctgttactattctttggcccaaagagagaaaggaatggagagtttattagaacttggaaggaaagagagttgtgtagagcagtatatcttgagagaaacagtgaatttctattaaggagcaagccaacccaagatgtccttacagaaaggggagaataaaaattctgactttactctactccctccctccattctcctgctgtgatttcattggccaaacccaaccagaagctagaagatatgagagctcattgatgtagccatgcaaatgagctttcaaatcagctttcatacataggtatctagtatttgaggctgtcagctggtgcacacaatcagtgggaaatgaagctcaaaaataaaaaaaataaaaataaaaaaaagagagagatcaagaaaagctacccagcaggagcaatctggctaggacaccactgctggatgcaggtaccgctttcaccatacttttaattttattgtccctttatttttcagtcatagtctccagagcaaagtcctaggtgggagtattcaattggccgaggctagttcacctgcccgcaccctgtttgccaaggggtgggaagaaagaatattgcttgcctttgccctccctggtaggaattgcacttctgctttttttcaagactcacacaattagagatttgtagatattaagaaacagctcagaaacaaggtagttctctctcctctaaaaaaagatcagtctccactaacagtgacctcctaaatctttattaatctgcaacaggaaactagcagacaagagtacagagatctgtgtttttatttccagttctctatcttttctccctcatttccttccttcctccatttcctgatcgttggaaagcccctttatctctccagatctttgtatgagagagcagcattaagatcaccaaatctagttgtaagttcaaatgctgggccgtcaaaaaaacacatacaggcccaccaaatagcatgccttagtcaacattttcctggtagaaacctcttggtttgttgatacctaaccttcattgaagatgcatgtctctcaatacaatgttgtgttttccttggctgctctttatgtaggaaacatttatattgtatttatatccttaaaatgcaatgtaacattttttaacagagtaaaagatgagacacacataagagactcctctgcactgtgtgccttctgatatgcattcacaagggacaacaaatattctcactctctgaaaagtccatctacatttttctccaaatttccttgcctccagtctctaatcttgttccttccatgtccctaaatatctggccaaaccattaacccctgatcatgatttggtataggtctatgcctctggtcttctctccctccacgtaaaatgcagtgagaggcactgcttgaaggtttgctcactgggagcgtttgccgtattcaccgcttggattcggtatagatgctcgacctacagtgaatcttgaattgttggatccagaccaatctataattacatttctcaaccttcatcaatcatccttacactctattcccatacacaattccct

SEQ ID NO: 1581 - DNA, 1250 bp, artificial
  synthetic oligo
ggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgctctgctttactcttatttgagacagctgcctctaattccagcaaagctttcatttctcagtccttctgtaatcagatttcaccgtgtgctgtaggggaagccacccatggcaggtataacagactaaacgttcttgacatctttcgtttgtgtacattctaaacgagcaagtggctgaaggaaattaggggaagtaatttacacagggccttcagcttatatttgggcttgctataaaacaatatatcactctaagatgttgagactaatcagttcttttgaaaaaacagactccaagtagcaactaataaatactgacaaagctgctgcaaagacgccttatatgtgatggggataacgacatttttaaataaaatacaagtttgaaaaccatccctgaaattcttgctggcatgtgcaaagcaggctgtctccaatgaattcattataaaagtttacatcctgcttacaaccattgtgcatgtggttgaagatggcatggagtgtgtctgtggggaagggaaaggggaaggggaagggaacaggggagatgagttagctgggtaaacaaggccatcaggtggagacatcactaccagaaagcttctagaacagtttcatgttaataatgagacagaatttcttcagagcctctttataacctaaagcaaccttcccgacttccttaaggaagaagcttttggtctgaagttttcttttattattagtaagtggacctgtgatagtggccctgggcatcccttctctggagcagctgacagttctaggttctctggactccaccattagcactacttctttagtgaatataaggctctcagaagtcagaatgataccgtaaataatattgtaaattaagcccataatattagacctagttgagacctcagagccatgaaata

SEQ ID NO: 1582 - DNA, 1250 bp, artificial
  synthetic oligo
caagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcct

SEQ ID NO: 1583 - DNA, 1750 bp, artificial
  synthetic oligo
cccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggt

SEQ ID NO: 1584 - DNA, 2000 bp, artificial
  synthetic oligo
aacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgac

SEQ ID NO: 1585 - DNA, 1250 bp, artificial
  synthetic oligo
tgcagtcttggaaaagataaggtttaccctaacaacaacaacaacaacaacaaaaagctgcttttccaagttaaggtgtcagggattgttttacttggctttgctttatctgtttgcttatttggttagtgggttgcttggttggcagcattttgctattttagtgtaaaatccaacaaatatgagtctttgtattttgccaaggtagatctttctttttgccttgaaatatggcctgatcatttgccccagttgcaggaagattcgagacttcctcacattaaatgacaggtccagcctgcctggaccttcttggattctgatcctgtctttgtctgccttggagatacctgcactcaggtggtcattccagctgccctctagttgcaggcagctgaggcttgctcttatccagtggtcatgctgagcctgctaagttaaattaccttctttatctgtggggaagaggacacaaggcaactcagagatagaaaagataatgggcaatgacaagagagggttcttgtcagggaaaatctgacaaaaagaaggtagaagtactgctgagtctgtgagttatccaccctggaggctgtcaaagcccatgccagtggaggcttacccagaatgagctgcaggatcactcattcattcattcactcttttttctttctctttctctctcctttctcttctttctttccttacttcctttcatttttttctttctttcttccccatttcttatagtatacatttatccattcacctgcattcattaatgataacatttattgattctgcatttattatatgtctattctttcaacaaacatgtattaagtatctcctatgtactaagtactattctaggttccagtcttacaatgataaataaaataaggattctgacttaaagaaatcaagctcatacccaaacaaccgtattacaaattaaacataatacttgtcctaataaagttcctccagtggggtttctgggtgctcaaagtggaggggttatgtccagctacagagatctcagaaacttttgcagaggaggtaatatgagcggggcctgaagagatagaaggaattttcctacatagtcataggtgattgacaagaaatataactgtcagtaggtccagctcaaagaagggcacggggataaggcttgctggatcaatgccaggaattagatgactggagcacagggtagagcaagcaggggcaggagatgggtccaa

SEQ ID NO: 1586 - DNA, 1300 bp, artificial
  synthetic oligo
cttgatgcccacatctgcagaatggacataattattggacccacctcatagggctgttgtgagcattaaaggcagtaacccataaacatctggcatagtgcaatggaaagaatagacactcccagaaccaagtcttcttttcccagactccaaagccactttttgaaagtgaactttttcatatgattagtttttatatgtgatgaattttcgcaagcaaaccacacaacccacacccagatcaagaaacagaacatgaccagcacctagaagtccctgcccccttgcagttctacccatccccaagatgatccagacctctaacacccgagattaatacctggccacatttgtggcagccacttcccctgcacaattggcaaacaagatagtcatctatctggtgtgatttggaaggagccagaaaatccagctcccactgtgcctacatttcctccatgattgaggcattccattgtgttaagcattgctccccacccacggttctctttgaagatgcaaatccatctgtgttggggtaacagcaattccctagtctcgtagaaaaaaaatatctggtcaacttttcacgccagctcccagcacagctgaaccttattcaccatcaaagaggcagaaaacagacaagcacagaagaaggaagacagactttacctgcttcatgatttggcccaaggctcgttaagacttttagcatattttttaatctcgtgtttaagggacttaagccaccatcaaatagagcaatttcatcaagccatccactatacagaaaagaagcaggtggtgataaaaatgaatctggtgggaagggtggggggtgtggactgagagagagtgcccgtccctgttttcataacacacctttctaagtcaggcccaggagagtttctggcgctatgacgtcatcagatgtcaggcctttgacaaatgaggccggcccgcagctggagcctttgataagccatttgcaggcgtctgggagacatacacgctggtcttgggaatgcatcctagccccatctcaaattcacatcttttcatgttttttttttaaaagcatgccatgcatctgtgaagattcatggcttaaaatattttttcttttctctgacatttcaccttttcttcttattttattttttttaaggaaaagaaaatattcactccaaggttcatttagtttctgggtaataactgtcagatactaacggatagccccatacatccagcataaaataatagaatttgttgagtgccttagacatccaataatggg

SEQ ID NO: 1587 - DNA, 1500 bp, artificial
  synthetic oligo
ttctcattttcctaagcgctgcagctctacagttccttatggaaagcccctctaaactgattccagtgccacttagaaaatcagtccctctggcctttcccttctgctttcaggagggtgaaggctaatcatcaaactgattcaaaagttctgaattctcagagaaagcctgaacagagaccagaatgggtgttgcatcctgcctctcctgagcaccacattggcctggctgctcaaggctgcctggagaccaccgtgcactgccctgatctgtcattcaccaggacagccctgctcaacctcgtgggagcagctcacccacagcctcctcaccgacctcccgggcagcttgtcggagccgtctctttgcctaacacagaagctttggaatgaagcagggagagaaagacgtgagtggcggcggtgggggacccttctctgagcttattaagaatcttttgtgcgccatagaataagtccagtcttgtccgtcctgctccccctgcacttaactttttcaggcctgatgagcttaaatgcttcagttagtccatgaaaccaaaagcactccttggcctttgactgtgtctgggtttcttttatgtggccatcataattagacagtggcccgaccccgtggccggaggtgcctgctctggcactccacagccctgtcctgtctctggagactcacacactgtgccagactggaagaacagtctggaaggaaagcccgttgtcaaacaaatcatcgttctgggaacacaaagccgcagggaccctcggggtgctgctgacacccgggccggcagcatcagagagctgtgtctcctgtgtggcgctgaagccccaagtttggagacagaaagctggctggtggccaacagcagcagcagcagtggacaccttatctaaacaaagggagagggcaccaagcgtgaggggaaggggtaggtggacactgcgtgggtggtttcgtgttgcaatttttttttctcttttgtggctgttgttttctttttcatctattcagttttgtagtattcaacagccgggcgcttggcaaaacctggcagcgttatccacacggccgttttcagtccaaatggctcctgtcaacttttacagccccgcgctaaaactccaggcacgtctcttattgccagcacagggttatttatttgcccggactgtctggcctcacatttttcacgtgtgtgttaccccggcagttgcttcaacttccctctggcccttaaaacgctagtaaacgcccagtccaatttagagctgggaggtgttgagcatttcatcttttcaggatcctgcactggttaatgtcattttcgtctccgttcagcttttgacctgaaggaaggggaagccttctccactgtgaaaattactctttcactggaaaccattgttactaataataacctcaccaggcacaccatcgaatggtccggatgccccctgcccgcaggggtggggcacaca

SEQ ID NO: 1588 - DNA, 1850 bp, artificial
  synthetic oligo
tgcctataatcccaactacctgggaggctgaggcaggagaatcctttgaacccgggaggcagaggttgcagtgagccgagctcgcaccactgcactccagcctgggcaacagagcgagactccgtctcaaaaaaaaaaaaaattctaccctatgctatgcctccaggataacgaggcatggtagtgtgcatgcacatgtgtatgtgcatgtgtgcgtgagtttagagtaatggaaatcgattacacggcgggtgcggtggctcacgcctgcaatccctggactttgggaggctgagacaggcagatcacttgaggtcaggagttcgagaccagtctggccagcatggtgaaaccctgtctctactaaaactacaaaaagatcagctgggcgtggtagcacatgcctgtaatcccagctactagggaggctgaggcaccagaattgcttgaactcaggaggtggaggttgcagtgagccgagattgtgccactgcactccgacgtgggtgacagagcaagactgtttcaaaaaaaaaattgattacagcacatgataattaaaaattgacatgacacttcattattttaaaaattcctcagcagatcgtcgtgtcggggaatttctcactgaccccagttcacgaccatgtccatggggttttctcctttggtcccccttctctccctgcccctttctttccccacttgcaggccaccccctggaaaactctttctaattaggcagagcaattcaatcctcactaagcctcatgaaccttcccaaaccggagaaaacccaacaaagctcatcaaagtatcaaaatagttttacacctgccacagaaaagcactctaggtgtctgcccctcctacctctctgctgccgtccgtatctccataatttgagactctataagctggaaaaggcccagcagcagggagagcaactgtctcactttacagatgaggacactgaggttcaggttggtgatgtggtctgaccagcgccaaggagcacatgtctggaggtttggggctggaacccaggaatagagccgcctagatcttacctaacttggtacttcttacccttcataggttgtatcagcaggacgggctttgcccgtgtggtaacaggaagcctgtattcattctgcatttctaggtagaaaattgctccaaaactccacaacttacacagcctattttgatcatctcacacagtttctgaggggcaggaatgtgggatcagcttagctggtggttctggctccaagttattcacacaaggctgcaatcaaggcgttgtctggggcttcggtctccgaagaccccaccggggctaaaggatccacttccaagctcactaatgtggctgttggcaggaggcgtcagttccttgctacatgcgcctctttgtattgctgctcatgacataacttccctggaaccagtgacccatgagagagagaaagcaaacccaagacagaagcagcagtctttgtataacctaaccacagaagtgacacgccatcacttctgccatatggttgttactggtcatacaagccaaccctggtacaatgtgggaggggcctatacaagggtataaataccgggagggagaatcattgaggactatcttagaggctgcctaccaaacaactcaagatattagcagcttaaacaagagaaaaatgtattttcctctaacgcagatatagtctatggaaacagtccaaagttgatatgatggttccatcttcatgtgagatccagacttcctccctcatctctttgccacttcatggtctaaggtggctactcaagctccagccatcacatctgca

SEQ ID NO: 1589 - DNA, 1600 bp, artificial
  synthetic oligo
ggtattttgtgatagcggcacattaaatgtgctagatgataggcaacaaacaagagtccaccacaatcacctcctctgtgtagtcaaccctgcctggcaactgatgggctcaagaagacatggaattttctgcagcagcattctggtgtccactcatcagttttgtcagtatccagacagttgctgtggcagcagcggctgtaccctgatttggagctcacagctccggcagtgggtttttaagcacagctgtttctattgatggtttcctggctccgggccttcctgcatgtagcaaagatagcagctcccctagtgggtcaatcctgcaggttctgagagtccttggaaacccagcctagagttttcataacagccctctgtagtgggttaccatgggggcctctccaaagctatgtccctgtcctaacctccaaaacctgtgcatgtggccctattcgacaaaagagtctttgtaatgtaattaagtatcttgagattagaccagcttggattacccaggtgggctctaaatccttataacaggcagaaaaggggaaaacacagagaggagaaggccttgtaaagatgagaggcagaaattgaagtgatgctgccacaaggaaggccagtagcccccagaagccggaagaggcaaggaaggattctcccctagagcctccagatggagtgtggccttgctgacattttgattttggactgctggcctctagaactgtaagggaatcgagttgtttttaagccatccagttaatggtcatttgcggcctcgggagactaatacaccttccaatgattctgtaagcaatgatttccttgttttaaatccctttctgcttaaaatgtctggagcagtttctatttcttgcactaaaccctgagcggtacaactcccttcccattctggaaatgcaggactaggcaagccagaatacattttgtgagtaggaactggggccgaggctggacagactcagatttgaggctcataaaatggtaccatccctccctctgctgtcagcctcacaggcagatgcacttctcccggttcagcagaagcattggtcttgatagtctttttactgctactgtggcagcaaccatttatttttactttaaatcactctgcagccagcaccccggctcgcttctgccaagagtcccactgcctcctcagtccgagaacacagagccaggcggggcctttatgatgcccatctctcttttctttaccccttggagcccgataaagagctggaaagcaccagaacatgattgagtctttattccgataccagtgtcatcacttcctagagggcagcttgtcttggtcttcatccttttcccaaaccagggctctatatgttcaaggaaatgcagtggtatgtgtgcctgagtgtccatgaacttgtgtgtccgtgggtgtctctgagcccatgtacctgttcctgtgtgtgtatgtgcctttctgggagtttgcctttgtgtctggtgtctggatgtgtgcatctagtggctgtggagagagagtggcaggagaggaagtgaagtggctgtggttactgttaataccataaac

SEQ ID NO: 1590 - DNA, 2000 bp, artificial
  synthetic oligo
tcccagctactcaggaggctgaagcaggagaatcacttgaacccgggaggtgcaagctgcagtgagctgagattgtgccactgcactccagcctgggtgacagagtgagatcctgtctcaaaaaaaaaaaaaaaaaaaaaaagaagaaagaaagaaagaaagaaagaaaaagaaagaagtaactcgctgtttaggtcaccccttgttggcatccctccctgccctgtttcacttccccaggcagccactgtgcttcttgggatcttttcccaagtgagccacttgtacccacactctcatctcagggtctgcttctggggcaggtcacactaagacaacagtgcagtaataaagcgacctgagaagccatcctgtgttttcttgacctttgggcacttccagcctccagacatccagacagtggagagtctagtctgtttgcacatctctgcagagaagattccagcagcctctgtgggaacccagtctacagtccaattctcactgtcggacctttgctttttttgttgttttccatccttaatccctcctgctggaatttaaaaccacttcctcacttgatgatttttttttcctctttttcctagagctggagaatagctggccaccaacttcagggaaagacccccttatatatttttatatatttgagtgtaggtattcatgtttatgtctccaggctcaataatccccgttctttttgagattgcccatcagtcctgttttccaggcattcaatcagctttgcagctgtaagctgtcacccccagctgctcattgtagctcagcctgcgggctcctggagaccaccagatgcaggtttaacccggagaagttcacaggagggaggttccctagcggctgtaaatcaccctctcccttgcctcctccctgaagctggagaacaagccccagcttgctgtgaaggccataaaacttctcttctttaaaggggccctttgttgagcatgttcactgtagcaggcgtgcaagtccaccaagggcccataaaacttctccaggctttgtgtgggtgaccccacaggcccgcgcatcagcaataccacccttacacccgcagtggaactgttgccgggttcacccagaaactgactggcctcaatttgccttgtgatttgtttgttagctttacaaatggcttttgaggccagacaacccctcctaaccctgaatactgcatcagtgggaattcagggactgcccgggaactgctggaggaaggggaagggggttgggtcaccacggagattttaaaacaattcaccttgggcgttcgctgccctgaatggtgagccaggattgggatacggctgggctgtccttagggtgttttgtctcttgccctcgccagcctctgccagggccctgatccctgagaggcctcagacgcccttgcctgctcctggatgctgaatccactccagcaattctaccagccttgggaaagtgaagtccaagcaaagccaatcagcgggaggttaatattatacttatttcatacatagctcagtggttaacagcacaggcttcaaatcacccaaatgtccatcaacagaatggatataattatgatgggatataacagaataaagtgtggatagaggcagccacatggactagtcacacatacattctactgaaagaaggaagccaggcatgtgagagtcaatactatccacttccatttgtacgaagcttaaaaagaggcaacatttaattcatggtagtaaaagtcacaatggtggttacctctgggtggcaaaagggggatgggtattgactggaaaggagtatgagagaactttctagggggtgttagaaatgttccatatcttgaactgagtgatggtcacctaggtttttttgtatatgaaaagtaattcaggccgggtgcggtggctcatgcctgtaatcccagcactttgggaagccgaggcaggtggatcacttgaaatcag

SEQ ID NO: 1591 - DNA, 1350 bp, artificial
  synthetic oligo
gaacaactgaaaaatgtgaatgaaagaagtatgtacctatactatagtgtcaaatattgtactgtaagctttaaaatgataaattggaaactttccaaaagtggtttgaatatgggtcatttatttagtaactcagccaaacatgctaacattttctttccttccccattaatttattttactagcccttcctatgtttgccaagtggctatgttactgaaaccagcccaattgtcccatagaaccgatgtttacagtcttctaaaataaacatagatattgacccttccagttttaaagcttgaaacttatatttgtcttaactgagttccttcctcgggaaaataaccttcatgcctcccagatagtttcaagaaactgaaaccaggtcaccatatctagacaatgagaagccaggtccctcatccttcatgatttccttacctctccctaattcctgtttacccacatgtagttacattcctttcccactatataaacccccaattttagtcagtcagagagatggaatgactacttccctggcaacagtcgttgtctcagtgattggctttctgtgcagggagcaatggggacctagaccaaacccctggcattttggtaacactatctggttgggaggtgggatatcactgcactcaggagctttcatttactttacctctctggtctccaataattcaagcacagtaagtttcatagtcctattgctgaattttcaccttatttttctttagaacattctttttgataaatagtacttttccatttttaaagatacctattcaactcacagaaatttcaataaactccccatctcctgccacttattcccttactacactgtaacttcactacatagtacatgccattccctcccactgaagatagcttgcattatgttgcagatacttgaaatattgtttcctggctggcttctcatccttcaagtatcagtttaatgataaaatcctcagagaggctttcctgactatattacattaggcatgtacaaggaacttcattgcagctttatttgtagaagcaagaaaatatgaacaatcttaactgtctctcagtaggagaatagataagtaaactatatttttgcccaggcatggtggcttatacctgtaatcccagcactttgggaggctgaggccagctaattgcttgaggccaggagttccagaccagcctggccaacatgatgaaaactccgtctctactaaaaatacaaaaacaacaacaacaacaacaacaacaaaaacaaattagctgagcgtggtggtgcaagcctgtaatcccaactgcttgggagaccgaggc

SEQ ID NO: 1592 - DNA, 1150 bp, artificial
  synthetic oligo
atggcaactcgattaaggctgggaactccatttcctagaagcccctccctgctgtgtttccgggttagagttggccaaaagagaaccttgtgcaagaattgtagggcggaaggcgagcagcagtcactgcccctggcaggtttcccgtcagatacagtgaaggacagaaacagaggggccctgagaggccctgcagctcccggtttatccggctctctcctctgctccctcccagctaacatttcctgctgttggctctgctacccaacagctgcctcgggcccaccaccaggggcttggctgtcgccccacatggggcgggagctacgtagaggccacagctcccataaacctctccacgaactccccctccgcggccctgcttcggtggctagatgtgctttggcttctggaattttcctgcaagctctgatttgtccaactgcaccagtgcttccggcaacggctagtgactctctgatcttctgactcctccttccagacattcacttccccagctcttcccacagctgtgaacggttttattcctagaatactcacagtggctctgtttccctggctgaatcctgttacgatacttacagattctgctttacatgaaaaacagcataagaaaaaaaaaatgttctggagtgtaaggcagaattccacctgatacttagaatctatatatctcatgtgcttgatttatagattggatatgtgggaactaaggaaagaagattattcaatgaaccagtggaggaagaatcgtgtatgctttcagtgtagaccaaactggggaaatagatgagaaaggaataactgaaaagacataaccttctttatcttgtttttctaagctcaaaagatggaagaggggaaggaattggtagtgaagccatttttgtagtctggaaattttctgtcaagttttacataattccttagggcataccaaagaaaataatcagtcctgtctaccctctaagtaactatcttctcttgaaagagaaaggagtgattcttatttaggaaatctagttctttaaatataaaatacgaaattgagcctgggcaacataagggagaccttgtctctactaaaattcaaaaagaataaaaattagccaggggtggggcgcaagct

SEQ ID NO: 1593 - DNA, 1450 bp, artificial
  synthetic oligo
cggtggctcacgcttgtaatcccagcactttgggaagctgaggcaggcaaatcacttgaggtcagaagtttgagaccagcctggccaacatggcaaaaccccgtctctactaaaaatacaaaaattagccggacatgttggcgggtgcctgtaatcccacctactcgggaggctgaggcacgagaatcacttgaacctgggaggtggaggttgcagtgagctgagatcatgccactgttctccagcctgggtgacagagtgagactcggtctcagaaaaaaaaaaaaaaaaaaaagagtgctacaatcacatgaccatatttgtgctgaaatcctgtttcttactatcattcccattccatttcgttgagacttgtaaccgaaagagggtcaggttgcttgccacttgcagaaagaagccaaaataagagcaaggtgtgttaaaaagaaagtaaatttcattatccgttgctagcaaggaaaggctggccagaatcctttccaaaaattgccattttccaatttctggagagggggccctggtttaagaagaggggcttggactgcagaagaggcacggggggctaggaggtaccaggtggcatgtctcgctccaatggcttcttttgaattattgttccatctgctgaaggggccagcaccatcatgagtccacgcagctcacaaatcaatcgcagtcaatctctagctgagagtgaactccagccttgaagtaacctcctgctgaggagagaattccagggatatctggtccgtgtcagaattcagctctggaaacttctaaggaaatctataaccagataagtgagcatggtgtgagtttagcaagcatccaggtaaataagtgtgcatgacacatgagagcataatgttggaaagggaagggcgtttgaaagcacgtttcgtaagaccaaagaaaacacacctgcagtttgtctcaaagctacgtcttgagactgaggagaaaggaggaaaggaaaacaagtttttaaaacacagtttgaagctaagctgggtctaactctattgcccaggctggagtacagtggcgcaatcacggctgactgcagcctcgacttcccaggaccaagtgatcctcccacctcagcctcctgagtagctgagactacaggcatgaaccaccacacctggccaattatgtattttagtagagacagagtctcaccatattgcccgggctggtctcgatctcctgggttcaaggaatctgcctacctcagcctcccaaagtgctgggattacaggcatgagccaccccacctggtctctttttccctcttgtttttaaaagatatttgaaatttagctttatattctggccaggcacagtggctcatacctgtaaacccagtgctttgggaggccgaggcaggaggattgcttgagcccaggagtttgagaccagcctg

SEQ ID NO: 1594 - DNA, 1700 bp, artificial
  synthetic oligo
aacatcgttacctcacatagggtgcctaacactgtgttcagagttgtagaagggattttgatttttgttttgggtctcagtcttgtcccttggagcttttttttctttttctttttgttttattttttgagacagagtctcactctgttgcccaggctggagtgcagtggtgcggtttcggctcactgcaacctccgcctctcgggttcaagcaattctcctgcctcagcctcctgaacagctgggattacaggcgtgcgccaccaagcccagctaatttttgtatttttagtagagatggggtttcgccatgttagccaggctggtctgaaactcctgagctcaggtgatctgcccacctcggcctcccaaagtgctgggattacaggcatgagccaccacacctggctatggggctttaatgaggagtgtggcagagttccctgacagccgtgcccctaccatgctgggcttgtggacaggcaagagtgggtgtcacaggctgggtgtactgctctccctctttcctgctgggggcactgctgctgtcacaactcttccttcctcttccctttgggtaccaatagccgaagggcacagctgagggaaagcagacacatgtggacagtaaccccagacgtcaccagcccagacagcagtgatcccgacttggccagtgatgttaaccagcagtttctgtttaagtggaaaatagttcctaaagggaagctcctgcccttctatggttcacagtagggctaagggttagactggtggacacagcatggcatagggaaaaacagctcagtcccaaaccaacacagagcctgcctgaaatgcccgcattgactttgcttttcagtatttcaatgtcatgcacaaaatccaagttcatgatgtgtgtagctcaatggaaagaagcaaatgagcaggcaggagtcagatacaaatggggtgtgtccacaaaatgtcattttgaagtttgtggtttggcatttggaatgcattttcctagaggaaaacagaactatgttaaatggatattagattcctagactagacttcaaaattctatataactcataacatggctaaataccctctctggtttgtttttgtttttttctttttttgagatggagttttgctcttgttgcccaggctggagtgcaatggcgtgatcttggctcacggcaacctccacctcccaggttcaagcaattctcctgcctcagcctcctgagtagctgggattacagacatgtgccaccacgcccggctaattttgtatttttagtagagacagggtttctccatgttggtcaggctggtctcgaactcccgacctcagctgatctgcccgccttggcctcccaaagtactgggattacaggcttgagcccaccaacctggcgtataccgtttcttataatgaaaaattagtagtaaacaaaatgtctgtaataataattttagaaaacaaagaaaaacaatttccgaacagaaaataagagttttggccaggcgaggtggctcacgcctgtaatcccagcactttgggaggccaaggtgggcggatcacgaggtcaggagatggagaccatcctggctaacacagtgaaaccccgtctctactaaaaatacaaaaaaattagccgggcatggtggcgggtgcctgcagtcccagctactcgggaggc

SEQ ID NO: 1595 - DNA, 1250 bp, artificial
  synthetic oligo
gtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggccaggtgtgatgattacatagtcctatagtgctagtttacttggaagctgaggggcaggaagattgcttgagcccacgagttcaagtccagcctgggcaacgtatagcaagaccttatctctgaaaacaggtaataagacatctatgcttactgtacacactgctgcaataggctgctaccacaagtgtataggtgcttggttagattgagccatactagcggtttgatacgtttcaatctaacaaatacgtattcagcttttgtttcagtaagttgaaggtttgcagtatgattaagaattttttgcattgtaaggaagtatggttctggataatctttccagtcatgaactcaaaataagcataagtttttagggcagaattttgacacatggccatatgtattttgaagatagaaaagatgatggtacttgagtctcgatttagtcaaaataagcatggaaaggtttgggattgctagattggatagtcaatggctgaaagtgactcatggagtgaaacgatgctaaggagagttcagtttccactttatgtgaatgatgagtgaacatgacaatctgctctggaggaactgccaaaatttgaggttatttctagtctagcatggttaggattatggtgacataaatttagtatgtttacatactacattaatgtggtttaattttaattacacttaaatgcagttgtcactcttgggcactgttgatgtgtttcctggattcttggctgaatttcaagatttttaaaatggctttataggagctgtgtctaaccttcatgcttaaaatgtttcctttgctcctatgctctacgtgacctgcttgagtggccacaggcttgctctttagagcacagtgactttgttgatagggcctcactactcccacaatgcagagatacctacttattgtaggtacagggcattgaaagttataagactatctttgggttttgctttcttgtgttccattctatttttaat

SEQ ID NO: 1596 - DNA, 1650 bp, artificial
  synthetic oligo
tggtccaggtgaacaatggcagtatttgaatcagagagataggagtgatgatgaaaaacgtagatgaatttaagacatatagaggagggtgaataaatagagcttggtggttgattggatgtatgtttgagaggaatatttagggaaaagatagtggcttctgggtttcaggatagatggtgttgccacttactgagatacggaacattggagcaagttcagctttggaggaagaaaactggcaaggagtctcttgtagggagatacatcatcaaaacgtatctttctggcaagggtcggcatcctttgaattgaagcctagcaattatttggctagattgctgtgttgtttcagatcctgagaattttctgatgatacaacagcctccttagcaggtccacttggttgtgtaattggcatcgtacacaaaacatgtcccaaacggagtttccagtcttccttctaaaactgctcctccggcagtgtcccttatctcaggaaatagctgcctttccagttgctctggccaaatcccctggagtcatccttgatgcctctcgtctacaccatacacatgcgatcaatcagcaaatcctatcatttgtaccttcaaaatatatccagaatccagctacttcttctcacttccactgctaccccatttgcttcaaaccaatatcattttaacctttctctcctggactgttgcaacaaactgccactggcctcctttcttccactcaagctccccatccacagagcaatcagagtgatcctgataagccggatcatgttactcctcttatcaaaaccctccagactcctcactcttgtcaaagtcaaaggcctcattgtggcctacaaggccctacatgatctgattgccattagaggagtcctgcattaggcagaaatggccagtccctggttcttctgccatgatgagtcattggctggggttggttgagctgaggcagatgctgaagacattacatctgggtgcggtcagctgcctgagcttcttgcagctggatgacaagttttttcttgaaggacaatctgagcagcacatctctatgactgccacatatactcactttattgttattattttgactactcctggatctccaaattggcccatggtggattggggaagaaagaacagggaaggcaggcttacataataattcactgtgtctgggggttgtaggcctgccctcaatttgctgaggaggggttggtggcaagatctcttttcttttctttcttcttttttccctctttggctgggggagacaggaaccaataatactggattttgtgaatttgcttgagataactgccttaaaataggagcttttgagcattaaccaaagccttatcttttagtgacagatagggcaatccagggctatgggagagcgtcaatcctgtttacatattttaaaatatctctcacaacgaatgcaaatcagataccttaaaattttcagtcattcccaccagtgtgcacttcaaacagtgaactagcactggtagttattacatcatcttaaaaaaaaaagccactctcttgtaatcaattaaactcattacacctgaataatcattaccaatgatgtgtaatttaaattatctctgcaaga

SEQ ID NO: 1597 - DNA, 2250 bp, artificial
  synthetic oligo
tttgcataaactgtgtaccaatttgcaatgaaaactggcaaacaggaccataaagtttccttgaattagtaagactgatgagaagaaaatgagcagatatttgcatctggtttaaacgctcagttgagaagcattgtgccgtccccgctgtatttggttgacacccacagcaactccccatttcagtcatctctctgttttcaaatgcacctggtatttaatcttatgtgttggggtaatttgccaatgccagctccttgtaattaaaatacactaatattagaaatgaaaagagacatgtttcacagcagccatatctgttattaatgagttacaaagaactgtacaagggactcccatcttgccaaatagcttcctttcccgcacctgaatctcagtaaagatgggagtctgcctctcatggaggcttatctgggtttgtctattacaatgagcctcagttactgggcgttctgagtcattaacattctgtacacaatcaaacttcccgtcccccaagaaagagttatgcccaggcctcctacagctcaattgttcatttaaagagagaacttgtattccaaagtttgaaagaaacctcggaatatcccgcaggtaggagtcattcctacaggtcctggtctctgtgctggtgggagcatcctttcccggtcactccttgaacatcatgctgcagggacgagctgatgactaaaaataaccccctgcaataagtccaaggcaaacagcatgcatttcctcggactttttgcccaatcaaaatcatacagtaaatccatcctcatctcctcccggtgctccccaatgcatctatggaagcgaagacctgcacgctgaaagaagagtgcaagggagcaggattcctgcaaagcgtgacacagaaagctagaaataaatgttgcctattgtttgaagtcattctgagcactccggcagagccctggcaggagatcagcagcatacataagtagtaataaaagtaaacagtgcgcttttaaactcgcagtcttgcctgcgttaatagtgcccccattgtaagtgggatgagggtgctggggaagatactgggctccatgaatccatgttggcaagttgctgcttcgcagccccctttcacggggtcaactataagaaccatcacaaagttacatctaactacgcagagagtttgaaaagaaaaatctctttaagtcaaaccaaaagatattttcaagcttttctaggaggctccctgctctgtcacagacttcaaagacccgttcatttaagaaacacaatgctagcatgctacagattaatgcaaattaaagtaatgcaaatttaagtggtatttaaaggttgtctctttgtctgagaggaggatgaaatgctcggtttggaaagaagcgatttcctaggcaagccggcagcgcttgttttcctgcttaccttaggggaacgcagggctcctttcttctcagacttttctgagagctagaaagaggtcctgttacttccaaatgcttttgttcttctgtccctctgtcacatggcttgccttttatatttgcaacacacaaaagttaggactgttgtttaagcgacacagggagagagagagagggagagagagagggagagagagagagggagagagagagagagaatgtcaaatggaaaagtgccattgcagtcatatatcaatcaggcgtgcggccgcagcagcgcactagcaaatgggaatgccacggaaatgtgaggcgctcgttatcggggactcagcctctgcccaccgctcggctcccttccacggagcatcttacgatgggaacagcgtagcagaacaagggcgaggaagtttctttctttctttcttttttaatggtattatggaactaataagaggccaaatgaatattctgaatttaattctttttcaagcatgtggctgccataaagatgtgccgtccgcaatagagacgtatagttttggaaatacaaaggcagtgtggcattctgttgaacgattcggcagctgactgtgatgaagttgaaattttaagtaagagaggggaaagatgggaaccagaaatttttttctcaggcgatgctgttaaagcaagtgcaaaacgctgccctattttatcacgatgtgtgtgggtggtgagagttctttttttccgggttgttcatccattaaatgatttttagcagcatatacatgattaaattcacaatggcactttaata

SEQ ID NO: 1598 - DNA, 1950 bp, artificial
  synthetic oligo
caccagccaccgcgcccggccccgcgtgggcttctctaattccattgttgttttgagattcgcttgggcctagctgtcatcgcagccctacattcgggctgggcggtcccgcggcctgggcgtaggggcgtaacagtagcaacagcagcggcggtggcagcagccgcagtctcttcccaaacacgagcaccacaggcgcccgaaagccgacagaggcgtttagagaaaatggcagacgatattaatattgaagcaatgcttgaggctccttacaagtaggatgagaacaagttgagcagggccaacggccatgaagaacgtagcaaaaaaaggaaaaaaagcaagagcagaagtcgtagtcgtgaacgaaagagaagcaaaagtaaggaacggaagcaaagtacagatcgagaaaggaaaaagagcaaaagccgtgaaaggaagcgaagtcgaagcagagaggcgacggagccgctcaagaagtcgagattgaagatttagaggccgctacagaagtccttactgcggaccaaaatttaacagtgccatctgaggaaagactggattgccttatagtatcaaattaagcataggacgttcccgaagcaaaagtccactcagaaaagacaagagccctgtgagggaacctattgataatctaactcctgaggaaagagatgcaaggacagtcttctgtatgcagctggcggcaggaattcgaccaaaggatttggaagagtttttctctacagtaggaaaggctcgaggcgtgaggatgatttccgatagaaattcaagacattccaaaggaattgcttacgtggagttcgtgggtgttagttcagtgcctctaacaataggattaactggccaacgagttttaggagtgccaatcatagtacaggcatcacaggcagaaaaaaacagagctgcagccatggcaaacaatgtacaaaagggaagtgctggacctaagaggctttaggtggactcattacacttttaacataactgaagatacgcttcgtgggttctttgagcctttcggaaggattgaaagtatccagctgacgatagacagtgaaactggtcgatccaagggatatggatttattacattttctgattcagaatgtgccaaaaagtctttggaacaatttaatggatttgaactagcagggaggccaatgaaagttggtcatgttattgaacgtgctgatgcttcgagtactagttcatttttggacagtgatgaactggaaaggactagaattgatttgggaacaactggtcgtcttcagttagtggcaagacttgcagaggatacaggtttgcagattccaccagcagcacagcaagctctacaaatgagtggctctttggcatttggtgctgtggcagaattttcttttgttatggatttgcaaacaagactttcccagcagactgaagcttcagctttagctgcagctgcttctgttcagccacttgcaacacagtgtttccaactctctaacatgtttaaccctcaaacagaagaagttggatgggatacagagattaaggacgatgtgattgaggaatgtaataaacatggaggaattattcatatttatgttgacaaaaattcagctcagggcaatgtctatgtgaagtgctcatcaattgctgcagctattgctgctgtcaatgcattgcatggcaggtggtttgctggtaaaatgataacagcagcatatgtacctcttccaacttaccacaacctgtttcctgattctatgacagcaacacaactactggttccaagtagacgatgaaggaagatatagtcccttatgtatatagcttttcttctttcttgagaattcatcttgagttatcttttatttagataaaaataaagaggcaaggatctactgtcatttgtatacaattcccgttaccttgaaa

SEQ ID NO: 1599 - DNA, 1750 bp, artificial
  synthetic oligo
catctctttataacatggaatattaatacagagtctaatattacacgtatcaatatagacaaatctaggccaggcacagtggctcacacctgtaatcccagcactttgggaggctgaggcgggaggatcacctgaggtcaagagttctagaccagcctggccaacatggtgaaaccccatctctactaaaaatataaaaaattagccgggcatggtggtgggcacctgtaatcccagctacttgggaggctgaaacaggagaatcgtttgaacctgggaggcggaggttgcagtgagccgaaatcatgccactgcactccagcctgggcaacaagagcaaaactctatctcaaaaaaacaaacaaacaaaatagacaaatctcaaaaactgccaggcaaaaaatataggtagctgaagtacacataaaatttcacgacacatatgtaaagctggaaaatactcgaaaaatacggtaatatttatggataatacatgcatagaaatgataagcagcaaatacaagattatacaatgttcatgataataaatgaacactcatatgccccacagccctgcataaaaaataaatacctcagagataactgaagctttatctcagagctcatagccctgcctcccttatccagaggtaaccattatcctgaatttgcttctttaatgttagcacactgcccaggactgtatatagccagggcaatagcctcttgcaaaacatgatgccttggcagagaagtctgataaggtcaaaaatacctcatttccttttgtggtaaaggcagcctggaagaatgaggaaggcctgagcagccctccccaggggagtcagggccataacagctgccctgggcagataacagcccagctctagggctgggagaggaaagctagatgcagtggttaggatggtgagctgtagctggctctgtcccttagggaatcaattgtcgctacctccaccattccctccactctctctctctgtctctctctctcacacatacacacacacacacttgctcacacatacaatcagattaccacaagtcagtcccagatccccataaaacaaagcaaaagttgggtttcagaaaatgaatcgtagaataatatagaattcaataatgatatactgtctcctaaagcaagtaactccgagtaatcacaaagtcacctcgaaccaacaaatgtttcttaagtacttactatagtcctaactttgtgccaaatatacgagttaaaataagcataagactcagcccctgccctgaagaaaaaaacccacaatcttgcggaggaagcaagatttagatatataaaatgataccgtttggatgtttgtcctctccaaatctcatgttgaaatgtgattctcagtgttggaggtgggggcctggtgggaggtgattggatcgtgggggcagatctctcatgaatggtttcacaccatccccttagtgataaatgagttgtcgctcagttatttcacatgagatctgcttgtttaaaagagtctgggacctcccccttctctctctttctcccactctcaccatgtgatacactggctctccctttgccttccaccatgattggaagctttctgaggccctcatcagaagcaaatgccaacaccacacttcttgtacagcctgcagaaccatgagccaattaagccttttttttttaataaattacccagcctcacgtatttctttatagcaacacgag

SEQ ID NO: 1600 - DNA, 1200 bp, artificial
  synthetic oligo
aagtcctgtgctcaagagatcctcctgcctcagggcacatctctttagtctcctttaatctggaccagttccttaggctttctttgtctttcatgacattaacatttttcaatagtacagcccagttattttgtagaatgtctttcaatttaatattgagatttccccacagtgagattcaggttatgcatttttagcaaaaatactacataggtggcaattacattttaaattctatgtgtgatgaaaacaatatttaatatgtttttccctctgactacatataagtcagatgtaatataatctaaggactccaccagatgaagaattatttttgagcgagggggaagttcagtgcgctactgatatttgaagccaatattatatctctgtggtatacttattgtgatataaaagaacagtatactttaacaagagcttactgtaattactgtcatgcagaaattacaagaagattttggctctatatgaaaacattctaacttttagaaccacataaaaatggcttcaattttgtgaactcgctaactctgaacaattttactggggaaggtagagagatcatttaggcatcagacaagggctgaactaaattacttctaaggtactttgtaattctggtctgtgttccagaaagcccgatgtctgggctcactccagctttctaagtgctggcaaggatctcactctttgaataaacaggaaattttgtacattaagagtctacatgtcatgtgaaaagatgctcaatttcactcaaaattaaagaaatgtaaattaaaactatgataagatatcatcttttacctacatgattgacacaaatctaaaagtttaataccacgttctgttggtgagggtgttgggaaacagacgctttcatgtattactaatgggaatgtaagctggtgtagaaactctttggaaggtaatttagccatagctatcaaaatgatattcatttacccttaaatgagcaattaaattttagggaattcattctacagatatacttgcactcatggaaaatgacataagtacaaggctaatcaatgcagcactgtttgtgattgcaaaagattaaaaacaatgcaaatgtccatcaataggaactggttcaataaatgtttacatattcatccaaagaaacaccatgcagatgttaaaaacaagagggag

SEQ ID NO: 1601 - DNA, 1550 bp, artificial
  synthetic oligo
gtctgagaaaactgatctcaaaagttatccaagtatacaagagggggaaaaaacaattaatatatctcactagattcatctccctcccccaccctcatcccactccactgctaagagagagaaatttcagcactgctatcctgttttattatacattttcccttttgagttaaggattttaagattttgaaagtaacagaacaggaaccaaaagtagattcaacttccaatttggcttaaaaagaaagaaataattattatttcctatattacccaaaacttattctgttaataacagttataattatatattcaaattaataaatgaagattgctaaaattgcctatatacttgttagcagttaaagaagaaaaattttttccatttgcttctataagtagacatcacatgattacttctattgaccaataagaaactagtaaaatcaggcagtcacccaccattcttttctaatgttctttttcttattctattcaaccttttcagtatattcttaagaagccaaatcaagaaattagacattcatgcctaaaataaaattgcgttaccttatacatcatgaacaggaacctgttgtatataacacgggtattcaaagctttattgtctttttctagaaccctttaacataaaggcagctcagattcaagattagaaaactgaattcaacaggcaggaacacgcatacgaaaccagtaagaactactaatcacgacctctcaaaatgtcatgaaccatatagatagaaataaccccccttttgctgtactaatgtaatccaatagaacaaacttaaaattcgtgacacaaatgtaagaaacaaaaaacaaaaatctattgccattgtaatctacccttcccaatcaggagaggtgtttccgacgcattacttgaactttcattttgtacaactttcatcttgtaaggttctaactaaatacttgacatcttaatgcagaggaaaggaaaggagggcaagtagactaattctgaaagcatcccttcaaatttcatacatgctattcagactaaatggaaatctacatccatggaaagttaatgtcgcaattctactaaacagcccattctgattttatgtttctcctccactaacaagaaaaaataaaacaaccaaatctagctgtattacatatgtttagctaaactgatagcactcagctcatttttgttaattacctggcttcttctcagtctttatgcggtattctcgtgctgctcttttttagaactcctcactgtttatgtgttctctgttcaacacagttgttaggggtctgtgaacaatttttcaattcccacacacgcatatgatatctattagggagcaatgccacttttcacttaccaattctggataaaggagtatttcctggtgacagaatgctgctgcttccgttcactaaaactccctcttcgcagcttgataaatctgattataaaacgtctttgttccagatcacacgaggcgcttttcctacaaaagttttctaaagagttatctgcattt

SEQ ID NO: 1602 - DNA, 1000 bp, artificial
  synthetic oligo
aggaaaagtgttttgaaaagcagatatcaaacaactggttaaatgcaaagccacatggtcacaatggaaaaacaactcttttagaacagtaaaaagtcatgtaatataatgacatgcagaatttttatttaaatacattgtcagaaatagattagaccctgcttctcctcggaggttacctcaaaatacatttcacttcatagaaatttatataagtgtcaaaatattgaacataagagcaaatgggttagtactactggaatgcaataattataaagctagataggtggattaattgtcctacatacctgtggtttttcagattcctgtgcttgcttactcatgtacatttgactctttcagaaaccacttctggaagctcccggtctggcttctacactgccacctgtagacataaaagagaaataaatcatgtattattcgtcaacaatgcatcttttctaggcatctaacggggacatctggggaaaaagtggcaaaacatttgctccaaaagacaaaaatgttctttctcctctgtgttgaaaattcctaaggcgtccttctccccaatggtatgataaattatttgattagaaattgaaacatatgtaagtctcagatcatcaactatacaccactctgagccgatcattaaagagatggagtcgcagaactcaacttacagccatttcaagacctgtcgtttaaaattaaaagaaaacttcaccgctttgttcatctgtaattcagaattctgtaaattgacacaaagaaagatcaggggcgattcaggctaaggttactttaccacaaggttgtaagatgtctatttaaaataacagtaattctaacctgaactacagttttgtccaatccaaacagcagtttggtggggtattttcatcaaaatgccctatccttgatttgaatatgaatgactgcggaagggtctttctgaaaccccacggattttaatacaggtaggtcctttttccaa

SEQ ID NO: 1603 - DNA, 1050 bp, artificial
  synthetic oligo
aagcaagttttttgactactggcttgaatggtagtttcttataataaaactaggtttacacaatgaaatttcaagaacatttttaaacaagtctattccactaagataagatttctaaacctaacactgtaaaagcacacaaaagtgacttatttaattttgtatgtgcttcatgtgacataacatgtatcacttaataacagagtggcaaatggaatttcaacacttctttgttgtactactttttgtaagaaaaggagcaaaatattgtactgaatgaatctaaagtagaattcattcaacaaacgtatggcatcaaaatttgtttggtaaaaacaaaggcaatcttgctcaaaagacaaagctgtacattctgatattctagtcttggttttgccacttattggattgtgcaagtcagtgggcctcatttgatccacgctatttacaaagtcaatttctgctctcatgttgtatctgtaggaggtaatgcatttggaattaaatcaagccgtcattacggaagcttaaatgttttgaaatgctagtgcaaaaaaatcatacactttcccaaggtaatctgagattcaagaggaagttatttgaattggtacagattctgattttgatatacctatggccttacaccataggtcattgtttctctggctatattctccctcccacaataaaccgtggaatgttcccatccatcattcaaattttaaaataatcaatttataaacccagtaaataggttatgaacctgagaacccctataagttccaaataaatgaaatgataccagcctacactcaatgaaggccaaataaaattatgagctttctgttttctcctggtctagtctcatgtgacagcagagagaaagggaaagaaaccgaacagtttttcatcatgtgcccctaccaattcccttcctaactggtgtcgaatcaagcataggggggtatcattcaaggtgacacttactgattccctttccttctgcttaggggccagcacatgcagcagcctgaaacctgacctcag

SEQ ID NO: 1604 - DNA, 1050 bp, artificial
  synthetic oligo
ctttcctcagattaatcaaaaaataagagtataacactatttgcctttggttttaaacatttcataactacttctttatggatatagccagagaaggaactataattcttcgttccatgttgaaatgttcgtggatgtattttcaaatcttcagtctagaaaaaacacaggcagcataaagtcaggaatcctgatatgaggttgcagtcaagcagacttcgttgccagagcctccaaattgctttttcatgttttctgtcccatttaacaccaagtttcccataatccttggagttccgatctcaattgccttccttctctttaacttgataattctatggtcagcttgacttgcactgctgtgtactgagatgcagcctctcatgggaggaatccccccacccagcacctgcctcgccttgttcagatactgcaggtgaatgaattaggagaccattaaagcatgctatttttttttgtttgtttaactctgaaacagcgcactactatgtgaaaaaagtgggaataggtctacgtttgtctgaatttagagacacttttgcctcaccatctgcattgtgagttaaattttaagtgttacaatagcttcagaccccaataaaatagaagagttagttcaatctagtcactgccccacctccaacaacactagggcttgcagctgtcctcaccccatcgggagcctaccccatcgcgccagggcttggggggaaagtcaagcattatcttccaggggaaacactaggcgggtgccccggctcgaaaccttctggtctcccattcccaggtctcgctccagcacttcctccgagctgctcttcgttctccggctgccctccagactcgtggaggcggtgtgcgaacttgaggagccatttgcagtcactgtgctgtccccgtaggtcaatgtcaggtcgccttcggtcaggatgaaatcagagtcttcctctctcagtggctcttggttctgaaaagtgcaaccaacaacaacaacaaaaatgagagactgatatcttccaggtttggcac

SEQ ID NO: 1605 - DNA, 1650 bp, artificial
  synthetic oligo
gctcaagtctcattgtcaaatcacagtgggaatttggctatgaaaacaattactgtattagtttgaacttttgtggcttcaagtgccaggaaactcagctcaaacttgtttagcatcatataataataatgataataatccttcgtaacagcactagacacagagatgcaccacccggatccccctcaagggaaggacttgctgcacagctgcagggactgcagtcgccagatagctccagctccagtttgtcagtttcttctggggctgcctctggtggggagagccatctcccttgaagtcataccctctctatacaacccacatccaatgactgtgtgaggcagagctgtaaacacccaccttgagacaactctgactgaaaatacttccagagctccctgctggactggctaaggcttcatcagacctgcttcagcatcgttcggcatcgctcagcatcgctcggcccaatcctgtgtcatccttctttcacaggtattatcccttccttataaacactttgcatcccgaactccatctcagtgtcagcctctgagggacccagcctgccacagtaactgtttagtcagggttttccagagggacagagccaataggacatatgtatatatgaaagggactttactaaggagaactggctcacgcgatcacaaggcaaagtcccatgacaggccgtctgcaagctgaggaaagagagaagccggtagtggctcagtcggagtccaaaaacctcaaaaccagggaagccgacagtgcagcccccagtcggaggctgaagggcctgagagtccccggtaagccactggtccaagtcccagagtccaaaggccaaagaacctggagtctgatgtccaagggcaggaggagcagaaggaagcatccagcacaggaaaaagaaggaagccagaagactcagcaagccagcttatcccaccttcttccacctgcttcgttctagctgtgctagcagccaatggaatggtgtccacccacattgaggataggtcttcctttcccagcccactgactcaaatgtcaatttcctctggcaacagcctcacagacacacccagaaacaataccagctatgtagctacccttctatccaatcaagttgacacctaatattaaccatcacggtaacttagctggccattggtaaatttggctttggccatggttgcacatgggaatacagagctcaaaaatatacaatcaagccctgtcttccgtctctcagtacaactctgctctcatctgtctgttgacccattcataagaggccacctcatggctggaaggtggctgccaggaactcctgggatgatatccttccatttcacacccagcaaaaaggagcaagcatctttatcccagcatccccagaattcttgaagttcacagtaacagggctagcatgggtcaagtgcccaactctgaaccaatcactgtggctgggagaaggtgatgctgattttcttcaggtgtaggtcatatgcttcacactgagagtgtgagggtgggagaggaataatttgccaaatgaaagctcggaggtgtggtcagcagtgggtgaaaatctttttgctcagaaatgtcccccacaatcactccttgagtcagttt

SEQ ID NO: 1606 - DNA, 1850 bp, artificial
  synthetic oligo
cccaagaagttgaggctgcagtaggccaagtttgcaccactgcactccagcctgggtgacagagctgtctccatggcctggcactggttttcatcctggtattagaaatgcatcagtgctccctggggaaggggccagtttcaccagctcctgccccatgagctgtgaaaatgcacattctaagaaggagccaggcagggcctgagtccctctgtgacccatgggccatgataaaggtgttggaacaatcgtgccaatatggccacaggaagcacgattgttctctccttgcgcattgcaagggctggaggttgaaggtgtgacctgtgctgttgtcccaggagccggggctttctcagaagcccttttcttgtgatgcccaaacaaccacgcagaaaatgctaattgattactcaccaaaacgactgtgaaaaaatgatgctttgagcttcaaagccccatcacagcttttatctaaccaagaaaccctaggccaagcttgtgcacaagctgggccacatgtggcccaggacggctttgaatgaggcccaacacaaattcctacacttccttaaaacattacaagatgcttttgccatttattttttagctcatcagctatcattagtgttagcgtattttatgtgtggcccaagacaattcttcttcttccagtgtggcccagagaggccaaaagattggaaaccctgcctgggcttttccgatttagccctcccacatttcccagagcaggacagtccctcacaccagtctcaaaggccagcagggcttttcctcacagactgagagctatggtcgctaaagtgatcagaagtgatgataacataatcaagactcttccttagggcttgagggttccagcaaacatctctgccatctgtctgcctgctttttctgtcacttctgaaattctggtatcatgcccgtggtcaaagcaactaacttctgtggctactagaactttcttcctgcttttctcactctgcacttcctgctgctgtcaatgaaactcagcttcttattcccaggcactctcagagtgaggatccataggaggctttgattctcaggacagataaccccatctttcctctggttctgacctatttttctgtgtccttgttactgtggtcatacccagagaagtaacattttgtcttgaatttgtaaaaatctctacctttccccacaaagggatttcagcacagtggctattttaacagataccgtgcagcacgtaccacacgttcccttcctgagtccttgaaagtaattttcagcttttgatcggctatattgttcttcccagctacattttgggaagtccagcagaataacttgctactcttttaaaggtcctaatgataaaacgaaacaaaacatcccctttttatcatcacccacaaagccctaatgcgtgcaacaaagattgtgaaacgtccagggaacagtttgtgagacagaaaggatggctttgttgattagcaaaaagctggaacgtggacaccggcaacacaacaggattgggacccgccttcttcaagtgaaacaaagttggaattattttcaattttaatgttaaatggtttttttgtttgtttccaaattatttgaaaagttactaatccaagcgtggtatgagtggtatcattttggtaattagattaatgcactaccagatcctagaatttcccactttaccaaataaaagaatgttctgtggaattctcctagaccaagacaggcttttcccctgagcaatagtgataaagttgtctaaatacatgaactggtggcatttttcaaaaagtaataatgttataatcaag

SEQ ID NO: 1607 - DNA, 1600 bp, artificial
  synthetic oligo
tcttactaggcctgattggttgagatagaaacaacatttcttacccaatgagaggcagaggccccctttttcaaccattataagatttagtccccatctgttttggaggactactccagccaaggagtctagttggtcatggactcttataaagcttcgggctatatcttctaaagagccctgtagttttgttgaaagagccttaaagtatgttaaggaggtggctaatccgcttgctcccaatcaaagtccagaggttatacctaaggcggccgttaaaggaatgacatggatggcccatctttttctaacatattggacggatgggatgggcaaaggctgattaggaggaactagtctgatggagggaaatagataaactagggtacaggttccggtccagttggtggggagacaaagataggtgttgctgccacacaaaaagaacaagactttgctgtaaacacaggcagaaatatggaaagagaacaagtgaattaaagatggggtgttttttgttggtttgtttttttgtttttttttcctgtggttcattactccagactgacaaagaggaggccagggaggcgcctactgtagtagagatataggaagagttactttttacacatttaatgcggtcggatgttgcgccattaatattgagccatggaaaaaggtgggcattagggaaagcacaggttaggcctggaggcattggttaagggagaggccgtaaaacgagccggttgcagaaatgttcccatttgcttcaagtgacacttggtagttaatttgattagtttggtagtcagaggggtgtttaacaacgatagcggataggcggttgcattggttaagtgttaatgaccctacagggatatttcccttagaggccgaaaagtaaagtgaggcttgttgaaaaaggggagtgtgtttagttataggcccttcaatgggagggccttggggcttaaggcgttgtagggagttgtaataggtttgaaataatttgttagcctgattggccctggaagtgggataatcaccgattagagtgtcaacttttttaaaaagggaaactcctttttggagtttataaattagggttatatttccagttaaaaggtcatgaaggggtgcaggaagggctgagtaagctgaggaagacagtgataaacacatccagcattccaaagcaagggaagagttagctggcagtaagagggactgtgtaaggtttatagagtgttcgagcttgagggcagtgaggagtggttgtactggtgagattgatgtacttagggaatttatattaaaagaagcaagcaaaaagagaaaaaggttatttgggtaggagtaaagtcctggaaagttccttgaagccataggtcccataaaatagtaaggagctgatcaggatgtgcaatgggagcttcataagggtaccactgaaggtctgtagcaaggcagattaggaagcgatgaaagtttggaagagaaagagacataagcggcttatgtggagttttcctttttttcctctgggattcaggtgaggcaaagggaagtgggtcctgtggagacacaagaaaaggct

SEQ ID NO: 1608 - DNA, 1100 bp, artificial
  synthetic oligo
aaaaaatcctttataataaatcagtaaacatagtcagttttgtgtttcctgttgagggtgagcggccactgtctgggccggtggctcacaggtaaaagaatttaccacgacagttgtaggtaaagaaaggcagatttattagagaaaggaggaaaatacattgcaagagagcaacaggtagaatcagcaaaagaggaactgacttcgaggaaatgaaggcttgctggagattttataggatggttcttgggctgtttgataacgccaaggtagcagggagctaacttgcattcttctgtcagccaaggtgtttgatgatgaattggagtgtttgatgataagcaggaagtttgtgagttatgtacattatttgctcaagaagactatatgtcctgggccataaagaaagacagacctataacttaaacttatctgcatcttctttttgtttatatgtcctggagcaactccttttccctaattaggactccacatttccctgagttttttttttttttttttaaatgcagggtctctctgtcgcccaggctggagtgcagtgacagcttgcttactgcagcctcagcctcccgggttcaagtgatccttccaagtagctaggaccacaggtgtgtgccaccacgcccggctaattaaaaaaaatttttttttttttaacagatgaggtgtcactttgtttcccaggctggtcttgaactcctggcctcaatcaattctctctccttagcctcccaaagtgctggcattacaggcatgagccactactcccagcctttccttgagttctatgagccactctagcaaattaattgaaccctaggaggggattgtgggaagcttgacttgtagctggtcagtacgaagctctggagtctgaagtgggggtagtcttcagaactgagccctcaacctgtgggacctgatgctatatcctggcagatagtgtcagaatggaattgaattggaggacacccagctgttgtctactgcagaattgacctcttgcttgatgtgtgaggaaaatccctcactcatctgttgtcacagcatgttatgagagtctagtaggagaaactgtg

SEQ ID NO: 1609 - DNA, 1050 bp, artificial
  synthetic oligo
tataaaaaggaaaggcttccatttattttaatatgaatttatgcacattctacaaaggcattaccacacctgcagaaaaccattgttcgtacttggagggagttttgatgatcattcctgttctgtgtatagttcacatttttacatggagatttctgtgtgtgtatcctgccttttttgctttaatagtacatgaaaataatttcccatgatgttacatagtattgataaacaatttttcaaatggttccataatatttttaaagagactgtctacctgagtttctttaatttcatattccctgtggcttcagatgtttccttttttaaggataatgctttgataagtatctttacacgcgtacgcgcacacacacatccatctctgatccatcaatctatcaaaagaagaggaggatggagaagatggaggaggtgagggaagaggaaaggaggagggctgctccttcacgtcgtgagctctgcgggtggttgcggagcctgggtgaacacgaccgtgaccgtggctgcgaaggcgggccccgccctctgactgcggactacgcggcggcgcctgtgccgcagtagcgctggaccttggcctctggcggtctctggcgccccctcccgttcgcatcgtgaagctgggccgagcccgctgcccgccgttcctcgctcctgtctgcacctcctcctccgttttgcttccctgcagcttttgccccgccccccttcccctgcctccccctggccctccgcgtgttaatttaggggccccaacccggggaacccctcgcagagccagctgctgtcgttaggcccgggtgagtgagcaggacgagagggcacggctggcgacggagcccctcccagcgctgcggcgggagagggggctcagctcgagtcgccacccggactcgccggacccagagctcctctttggggttcccgctctcccgctccccgtgctcctgggaagaggttctggaaacgaccgaatctgggtgcaatcggggtggcgcacaatcgcgcccctccagtcccctctgc

SEQ ID NO: 1610 - DNA, 1950 bp, artificial
  synthetic oligo
tcttttattctccttttcccttcttcttccttctcccatccaccttctcccttctcctccttccttcctcttcttcctcttccttttttttttttttttttttttgtagagatgaggtcttgctattgctgctcaagctggtcacgaagccatttctaaacattttctattctcatcagctgaacaagaatctggacctaacatttctccctgcccaacccaaccataatgtatcacctacctaaaagccattcttttttttttttttttctaatttggtcttgaggtctgtctcatgagagtggccataaactctaaccccatcctgttggggctccagggaatgtggttgtgggtgtttacaatgggccttccagagaattctttgtcctggtgggcggcttagtgcctgtgtctgacgcatgaccaggtgtccctctcccagaaaacctgttcattctggcagacgcccttgtggctcttgtctgacctgagtccagcttattcccaccaagatagccactctctaggagagctctgaccgggagagaagttaggtttgggtgtgtggggcaggtgagacgcagagaggcaactcaacagaacacatgaagtcatggaggcagcgcattcatttcaggtccagacggaagagggcagcacacctcacagggccaaggggatgcagagagctgtccacgacacacatgctcagccagcgagtggggacagagaagggtatgtggggacggacctgtggggtgaagcctttttgggggcctagggcattacctgagcagctttcccatgaagagttctaattggtgggtgtagagcaagcaggcgcaagttccatggagtcaccccgtcactgggaggtggtcactgcggcatatctgtgcagtccacatggggtgtggggattagaggggcgagtcaagtgggttgcgtctagctgtccgttgggggaggtggtcaccagcaggtgattgtataagcagttatctgggtcgaccacattgaggaacaggtggagaactggagactgtgtcaagggtgactaagccctgcttctttcttgtatgagaaagtccaacttatattcagactggatgtcataaaattctaggaattcactacagccttgctctgtggggtgtagaaatcccttcacattggcacttggtttgggggagcctgttttggaaagtccccactcttccctcctgaggctgctaaaataaactgttaagccatgtggtttgtttgtttgttttgctagctccgctgtgttagccacgaggatcacagccagtttcataaccatacccctttccaagttgcacttttctttctctttcagtggctttagggcttcttgttttcccttcttgaccatctgtaatacaagaaagaagttgggaatggggtcgtaatgtgtctggtaaatcttatgattcattcataattgggaaaatcaggaaacaatccaaatatctctcaacttgtgaatgggtcagcacattgtgattcatccatacaatggacttatttattacacagccataaaaagaaacaaaattactgactaatacaatatggatgaatttaaaaagcattatgctgagtgaaagaagccacacaaaaaatactctattttgtgtgattatgtgactccatatgcatagctctgtactgtatgattatccaaaaccctagaacaggcaaatctagtctctaggggcagaaagaaggtcattggttacctgtgatgggagacagtatatagactgagaaggggcatgagggagccttctgggggagtatctatatgcggatttgaatgagttgtcaaaaaccaggcattacacttataatgtttgagcacactgtatactttactgtgtattttatcccccaataagagaaaagttaaaataaaaaacgtac

SEQ ID NO: 1611 - DNA, 1900 bp, artificial
  synthetic oligo
ctgacacccatggctccacctagactcaccaatcccactcatgtggccccaccctgaggcaattcagcatgcaggaggacagctttcacctcctatgatttcatctctgccccaaccaattagcagcaagcctagccacccccactgcttcccccaaactgcctttgaaaaacccccaacctacaagctttggaggagattgatttgagtactataataactctgtctattatatgccgtggcccgccttgtgactattaaactcttttttttttttaatagacactgagtctcgctctgtcgcccaggctggagtgcaatggcgtgatctcagctcactgcaacctccgcctcccaggttgaagcgattcccctgcctcagcctcctgagtagctgggactacaggtgtgcaccaccatgcccagctaatttttgtatttttagtagagacggggtttcaccatgttggccaggatggtctcaatctcctgacctcgtgatctgcccgcgtcggccccccaaagtgctgggattacaggtgtgagtcaccacacctggcctaaactctttctttactgcaatactgtggtctttctttgtgcagtgggcaggaagaacccctcaggtggctacagttgcacaacaatgtgaatatacttaacgctactgaactataaacctcgaaatggttaagatgctaaattttatgttatgcattttttacaataaaaaatgggatgttacaataaaaaatgggatgcaacatatgctcacctttgggtggtccccaggtgtgcatacgttgtggctgtacatgctagtatatatgttacatgtcttacatctccacccaggggtgtgtgtgtatatatatgtatatatatttactattaaaatgagcaaaacgttaccttgagggcaagccaagttgaagtgcacatgcttactgctggggaaagtccctactgaagttatgtcctgccagggccagataagtcccagttagggccagataagcctaactgcaagtccagatatggccattgttttttctgattgctagtggggtaaggtttccagggcttccttactttgaggctgcctttcctgctcatgtctgtctgtctgtctgtctgtcctgctgtctatctatctatctatctatctatcatctatctatcatctatctatctatctactctaacatctggaggttttttttttttgtcttgtggatggaaagatcttaaataaaattttagcaatttgaatccagcaagtatggaaagaaaaatttaccccatgaccaaattggattttccagtaaggctgttgatggtgattgtgagtcctcagttcttgtcttcttggtttaaagaatttaagcaagagacacacagcaagggagatacagccataaaccagtttattacaaaattgaaagagcactctgagagctgagtcagagtgggctgctcaagagtgagacacccctggctgacactagggaagctccctttaggggagttttacatgattattcttaagagggtgggaaagggcattgctagtaagtatgttatgggtggtcctctaggtgcacatgttcggtaactgtacatgtttgttcatacatcacatctcattagcatcttaaatctccacccagcagtgtgtttttcactagtataatgagcaaaaagtcagtccaaggacaagtaaaattaaagtgcatgctttctactggctgaagtccccactgaagttaggtcttgcctaagccagaggagcatgaccacaaagcaagcattgtgttaacacatcctgatagacatggctactttcttgactacgtctcctacttcaacttcaaggtaaagatggttaatgttaatacat

SEQ ID NO: 1612 - DNA, 1900 bp, artificial
  synthetic oligo
gtaaggaggttgtggggctccaggagcaacagaggttccccagatctgtgagcatgccctgcctggcactgcaggaagaggtggctgccacccaggtcagtgtggacgtacctctacctgtgtctcagaggaaacaaattctattttatcccaatatagctctgtattacacaaatgtaacattcggctactagatatggagtgccttatcttccatgtaaatacagcagaggataccctaaaagagatactgaaggatttgatttttctttctccctgggaagatggaatccataagttgggtccccaagcccacaagacaggtgcaagaaagggtggctggaagattgtgagtcatgacagggaacatttttccttaggttccttgggtatataaagctcccgactatctgtctatcatggatagataaagagtgaacatggtcccctctccacaaatgtgtttctctccttcattattactgtgaagggctgaaactccatcaagttctgatacattactcttttttttttttttttgagattgagactcactctgtcacccaggctggagtgcagtggcgagatctcggctcactgcaacctccacctaccaggttcaagcaattctcctgccccagccttccgagtagctgggaatacaggcgcgtgccaccatgaccggctaatttttgtatttttagtagatacggggtttcactatgttagccaggatggtctccatctcctgacctcttgatccactggcctcggcctcccaaagtgctgggattacaggcgtgacccaccacgcccagtgatgcattactcttttgagttttttcgagagaggatctcactctgtcatcccggttggagtgcattgctgcaattacagctcactgcatcctcgatctcccaggctcaagggattttcccacttaagcttccgaactagctgtagctacaggcacacaccaccacatctagctagtttttgtattttctgtagacacaggatcccactatgttgcccaggctggtctctatctactcggtccaggcaattctcctgcctcagcctcccaaagtgctaggtgcggtggctcatgcctgtaatcccagcacattgggattccaaggcgggcagatcacttgaggtcatgagtttgagatcagcctggctaacatggtgaaaccccctctctactgaaaatacaaaaattagcttggtgcggtggtgagcacctgtaatcccagctagttgggaggctgaggcaggagaatcacttgattctgggagatgtaggttgtagtgagctgggatcacgccactgcacttcatcctgggcaacagagcaagaatccatcgcaataaaatcgtaaaaataaaataaaatagaataaaacaaaacaattgctagttatttttgtattatgacttttgagctccattcttgttgcctaatatttgttaagtcagttctcccaacaggataatgttggcctagtgcttcaagatgattgctaatacagctgggactaacacgatgaaacttgatactgaactccagacaaacctgcctgattttctttttccttctggctctttatggctcaaatgtggcccatgtccctgatatagaccccttacctttctcttgacatagaccggcacaggtccatcctggtatggagtgacaatgaaacctcactttcagatggctgatcagtgaggttttcaaagaaagatcttcatcaaaagagggaatgtgaaagctgatttgttacaaagagcatctcctgggcgggcgcagtgacccacgctgtaatatcagcactttgggaggccgaggcaggcagatcacttgagatcaggagtttgagaccagcctggcca

SEQ ID NO: 1613 - DNA, 1400 bp, artificial
  synthetic oligo
cttggtcagactggtctcaaactcctgacctcacgtgatccacctgcctccgtctcccaaagtgctgggattataggtgtgagccaccacacccagcctgtcacttttcttttggagaataaaacaaattgagtcttgtgccaaaatgcaggggaagatgcacccagacaggtaacaaaatattatatacggtaatagataggttttctacatatcaataataaccatttagaaaatcaaattgagaaaaaagacacgtctatagtgacaaaagtacataaatatctaaaaccagatgattggagcaagatggcagatagatcccatgccccactcaacattccattgaactgggatgaaaatgttttcaagggtcaattcttaacagtagaggaaaataggaaagcgtgtcagtggtccaccaggaatactgaggcatacctgggagacagagtagatgggatcagactgatagagaaacccaaggagacaagaccacagctcaaatcactataggcgagagatgctgtctgagacagagacttactctgtcgcccaggctggagtgcagtggcatgatctcggctcactgcaccctccgtctcccaggttcaagggattctcccgcctcactccctgcagtaactggaattcacaggccagccaccactaccggctaatttttgtatttttagtagagacgggggtttcaccctgttggccaggctggtctcaaactcttgatctcaagtgatctgcctgcctcggcctcccgaagtgctgatattacagtgtgggtcaccgcgaccgcccaggagacgctctttgtaacaaagcctctgaaaatctccaaaccctgaatcaaagaaaacacggagctggaaagggccttaggaaaatcatcatgtaagttaatttaaaagttcatcagaaacgtctgaatcagccagattcccctccaacaccacagacagattggctggcagtagccacttttgcctctaagatgaaactctgataattattcattaaagaaactgaaggcctggcgaggtggctcacacttgtcatcccagcactttgggaggctgaggcaggaagattgcctgaggccaggggatccagaacaccctgggcaacatagtggatgccgtctctacaaaaaaatacaaaaaccagctgagtgtggtggtgtgtgcctgtagtcccagctagatcggaagctgaagtgggtgaatcccttgagcctgggagatcgaggctgcagtgagcagcctcgatcactgcatcactgcactccagcctgggcgacagactgcgatactgtctcaaaaaaaaaaaacacgaaaaagaaatgtatcaggacttggtgtaacttcagcccttcacagtaataatga

SEQ ID NO: 1614 - DNA, 1100 bp, artificial
  synthetic oligo
gatcatgccactgcactccagcttggacagagtaagaccctgtctctagaaaaaagcaaaaaaaacccaacaactggaaacatcctcctctagaatggtggtcaggaacatctgtctgccctgttccctgatgtctcttcagcacctataacagcgctcagcacgaggacgcactcattagggttttgttgaataaatgactcctttgacacagcaattccacttctaagaatctttcctaaagaaatattcacacaagtgcacagagctgtgtgcacaataatgagaggagcaaacaactggggaacgtttgcaaaggtttattaactggcagtgactgatagaggggaatcggatgaggggagtacatgctgaacaggaaacagagtgaggggggcttgaccaggacacatggggaaaagcagttgggagatgcctatactggtacttggtgtgtgtgtgtgtgtgtgtgtgtgtgtgtgtgtgtgtgcgcgcgcgcgcgcatgtgtgtctgtgtggcatgtgtgtgtgtttgtgtaaatgcagaggaaaaaatctgaaattaaacactcagaactgccctcagtggtcacatctgggaagagaggagggtagtgttgttctatgcagagaatacctgacgatacttgttttctgaggtaggtgcatggatacacaaactgaaatatgcattaagtatgtcttgctcatcagtgaaaacgctaatatctaacagaatggcacactgtaacaaaatacaacagaaacactaacatcgaactcttggcacactaagaaaaatgacgctcaacttttcactgttgtgaacacttgctttcacttgctatacacctgatgacgagggatccgcagccatgcccatgttcgtgaaaggtcaccacgttctgcttctcatcatgggcatgtgtcatatccccgaggctgaggcaagaagcgagaaggaaagtaagtggcagtgagttcccaccacatgacaactcaatctcaactcctcctgacctgcagaccctgcccactccgattctgccctacctcaggacctgtacacgccttccatggttccttgaagtgaaccatct

SEQ ID NO: 1615 - DNA, 1250 bp, artificial
  synthetic oligo
ccaggaatccggagctcagaggacttagaagatttgtgccaagtcgcctgccttttatatgggtgacaactgaagtgtgtgactcattattatttggagataatagaaacaatgtcttcttaaggattaaataaattcatccatgtgaactgcttaaaatagtatttggcatcactatgaaaacaaaagaagtattaaggatcacaactgttagtattagcaagccgtcggtgctacatcaggtgttgtgatagacatagggagaagaaggcagtgagggcattgttgatattctcccactcttacagggttcacattcgtgaagggacaaaggttctctggtcctttagatttgagagacactcaccttcgggaagattccctggagcctgccgaaagtcatctgaggatgttcaactgaaagagaatacatcagaatttttctttgttggtaaagatttccaaactctagagagacttcagttgcatgagggcattctgcagcagaggttatgagtccactgattgttgaggagttatttgagatttgcttctgaattatgtttagtcatggttggtgcatttatctgtggcatcaattcagaattttccatctcatggtttatcacatggggactaaaccccatcacagtctcatctttttccattacatatcttttacttattctcaaataattaaattgattggttgggaatctgaactgtatccactcaagatgtacaacaactgaaaatcattttacacttcaaatgggtgaatcttatggtatgtgaattaagctgttaaatgtgtgatgaaccatggatgatttagtccagtggctctgaaatattttcagtacaaagacagtcctttaacgtcaaaaacttggcagatactcaagcactggcttttcagatctcttatagtgattgtgggagattgtagagtctggcctgtttagttggcgagtaataggtctattggagacagtttggactttctgaccttgtcttataattgtgttgtcagagcagaagagcaagtaaacacatatgtcccctttatatccctgaaatgtacaaagatctctaccgaagaacctgtctttttttcaccccatgttatctctcctcactgacaagtgggaaagctctctgtgtgttggatgagggatcactctttcaaactcactcccgagctcatcacagagaatcagggttctttgggaattagaggactatttggt

SEQ ID NO: 1616 - DNA, 1900 bp, artificial
  synthetic oligo
tagaggctccgtatcctacaacctatcaatccagaaaccttgaaactcgtgtggggtgtttgggctgacacaccttcccaggaacaaagagttatgtagaaaaactatcggttaggccaggcggggtggctcacgcctgtaatcccagcactttggaaggcagaggcgggaggatcccctgaggtccgcagtctaagagcagcctggccaacatggcgaaaccccatctctactaaaaatacaaaatgagtcgggtgtggtggtgtgcacaggtagccccagctactcgggagactgaggcaggagaatcgcttgaacccaagaggtggaggttgcagtgagctgagattatgccactgcactccagcctgagtaacaaagcaagactctgtctcaaaaaaaaaaaaaaaaaattccttgctttcagcactttggagttattacaccattgtatccttgcctccagtgtggtgtttgagagatctgatgtcagttcaattatttttcctctgtaagtaacctgctatttctctctgatcattttaaaaatattttttctttctttcacaattttacatttcactgttcctgtgtgtgtgtactataatacctttaaatcttaagtcattttttttaatctgagaaattctctttcattatttatttggggtacactctcctttttaatgactatattctcttcttataaggctactattagatgtgttttgacatttattctatccttcctattaattaacttttctttcatttactttatctctatccattaccgattacttttatgaattctttagacacattttctcagttcagtaattgctttttcaactatatccgttttaatatccaacctattccactgaattatttatttgagcatttaatgttttcatatccaatctatccaataggttatttatttatttatttatgatggagtcttgctctgtcacccaggctggagtgcagtggcgcgatcttggctcactgcacctcgcctcctgagtccaagcaattctcctgcctcagtagagaattaaaaaaaaaaatagctgcatttcgtggtgcgtacctgtagtcccagccactcgggaggctggggcaggaggattgctttggccctggagtttgaggctgcagtgagctaggattgggtcactgcactctagcctaagtgacagagtgagacaaagtctctgtctctgaaaaataagaaaaaagattgtagggacgattttactcagagtggggagtactatgatatgtacacgggccactgcaacggggttttgggttaggagagtgatatcgggatcaacttcaactccaccaagggcaagtggggatttatagtcaaggagtagggtcagggggtcagaagatgggaaattacttggaggagacatcaggtgcaggcagattctggctaaacagacttgacaggaattttgctgaaacaggctaaatgggcagagtccctggatggagaggcatgagccacctcatccggccaactagctttgtttaatatgtcagttttcataagtaatctaggtataattgttaaaaatgaataaaagaggtaaatgtgagatacatgtttataaatgaacttttcatgtaatttgaaatcttttttctcttgctcttatcataggaagatgaaatattaaagttatgttatgttagatttagtaataggtactcgttaaatgtcgggatcacttccatctaagaaaataactgatacaaatcgctaaacataaatacaagtttgttcttggcccttaagttttataaaagagaaaagatatttggatctgttaataaaatgccctgttctacattgaaaatgtagaaaattgttctggccggg

SEQ ID NO: 1617 - DNA, 1450 bp, artificial
  synthetic oligo
aggttgtttcagcagttactaggtaaaagtggtcttagggtggcagcaggccatttcagccaccagccttgtggaaaattcaattattggggcaggtgcaatgtgccctgagtgctttttctcctggccactcaactctgacatagttgcggatgtcgaaaatgactcaatttgggtgggttgtggtggagcacacctgtaatcccagcactttgggaggccaaagcagacagttggcttgaggtcaggagttcgagaccagcctggtcaacatggcaaaacccttactctagtaaaaatacaaaattagtcgggtgtggtggcacatggctgtagtcccacctactcgggaggctgaggcaggagaatagtttcaatccaggaagctgaggtttcagtgagctgagatcatgcactgcactccagcctaggtgacacagggaaaaaaaaaaaagaaaaaaagaatgactcaagtcacataatcagctttcacaatggttaaagcagagtcctgcttagcaatgcacaaaaattctcctttgtgacccattcattttactgctgttgactttcttgcttatgctttcagacagagtcactctcctttgaccaaacttgagtcgggctcctctgagtcctgtttctgactaggtcccaacctcgggctctgtctttcatccaggaactctgcccatttagcctgtttcagcaaaaatcctgtcaagtcagtttatccagaatccccctgcacctgagttttcctctaagtaatttcccatcttctgacccctggctcctactccctgactacaaatccccacttgtccttggtggagttgaagtcgatcccaatatcactctcccactgcaagaccccattgcggtggtccctatacctatcacagaagtccccgctctgagtaaaatcgtctttacgatctttttttttattttcagagacaaagtctcactctgtaactcaggctagagtgcagtgacccaatcctagctcactgtagcctcaaactccaaggcccaagtaatcttcctgccccagcctcccgagtagctgggactagaggtacgcaccaccaaatccagctatcttttttttaattctctgcagacccaggaacttgatatgcccgtctaatttttgtattttttgtagagacggtgtttcgccatgttgcccaggctggtcttgaattcctgggctcaaccaatcctcttgcctctgtctcccaaagtgctgggattacaggcctgagccactgcagctggcccttccttacagtctctaataagtgcaataaatacttgtttgctttaacatttccctgtgtcttcagtctcctgaagtgttatatgcctgacatttccttactccacctgatataaaaaaatcctttcttttgctgggtgcagtggcttacccttacaatcccag

SEQ ID NO: 1618 - DNA, 1450 bp, artificial
  synthetic oligo
acggaaacactaacatcgaactcttggcacactaaaaaatgaagctcaacttttcactgttgtgaacacttgctttcacttgctatgcacctgatgacgaggggtccgcagccatgcccacgttcgtgaaaggtcaccacattctgcttctcatcatgggcatgtgtcgtatccccgaggctgaggcaagaagagagaaggaaagtaagtggcagtgagttcccaccacgtgacaactcaatctcaactcctcctgacctgcagaccttgcacactctgattctgtcctacctcaggacctgtacacgccttccacggttcctcgaagtgaaccatctgctcatgccacagtgacttcttcgcctgggttatccattcctaggctagaggaaggtgtggcccacatacagggctgacctggagtttggaaacacacagcatcctgggtagggagcatccctggatatacagggcagggagtaaaaagagcttgcgaagaccaggcgcggtggctcacgcctgtaatcccagaactttgggaggccgaggcgggtggatcacaaggtcaggagaccgagaccatcctggctaacacggtgaaaccccgtctctaccaaaaacacaaaaaaaattacccgggcgtggtggcgggcgcttgtagtcccagctactggagaggctgaggcaggagaatggcatgaacccgtgaggcggagcttgcagtaagcggagatcatgctgctgtactgcagcctgggccacaaagggagaatccgtcaaaaaaaaaaaaaaaaaacgtgggaaatctctcatcattcggcctcaatgctgtaccctagaaaattatgagaagggaatgatttggggaacaagtgacagatgggataccagtaccataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctgcttctgttgtggggtttagattcccaacctcttcacttacgggaacatccacccttacctcctttcattcagcacgtgtttttattgagggcaccgaggcatacttttttttatcgcacaacattttcatagtgcttcacagatgctgcaatgttttttttggaaactctcatcaattttacactt

SEQ ID NO: 1619 - DNA, 5800 bp, artificial
  synthetic oligo
ctccacctcccatgttcaagtgattctcctgcctcagcgccccgagtagctgggatttcaggcactcaccaccacacccagctaatttttgtatttttagtagagatggtgttttgtcatgttggccaggctggtctcgaacttacctgaagcgatccgcccatctccgccttccaaagtgctgggattacaggcgtgagacaccactcccagcattgtcttagctattgacaatttgttacagcaacaatcaaaaatgaatatacttagaaacagattagtgtaacaaaatagaaagtcaagaaacagactaatttatataccaacttcagcatgcatttccaaacaaacagtgggcaaaagatgggttgtataataaaggattgttgacaagtgtctatccatttgaaaaaataaagatgaaatccttatgctgaaccacataaaataataaattctaaaagttcggagacataaatgtgaaaacgtgaagtcataaagaactagatgaaaattcaggaaaatattatagtgtaagagatcttgaattggcataagcaaatcctgacattacaccaaggatataaacaattaatctgacatagttaaagatgtaaaaattaaagtatcatctaagtcaaaagacaccataaacaactgtttaaaaaggcaaattttaggctgggcgaggtggctcacgcctgtaatcccagcactttagggggctgaggagggcggatcacgaggtcaggagatcaacaccatcctggctaccatgatgaaacctcgtctctaataaaaatacaaaaaattagccaggcctggtagcacatgcctgtagtctcagctactcgggaacctgaggcaggagaatcacttgaacacgggaggcagaggttgtaaatttaagaggaagcagaagatttcaataagcaatggtgaggagaaaaatactagaatttattgaaaagtgtaaagtttagattgtaaattaaaaaaattatagtcttgaactaaatttgcaggtattataaacatggaagatgggaggagggacagaaaagaaaagagaagttcttttggtgttcaacgaatggatacagatactaatgaatgatagaatggtagaatggttaaaaacacgagcattttattttgttttattttagacagggcctcgctctgatgcccaggctagagttccttagcacaatcgtggctcactgcagccccagcctcctctgctcaagtgatcctcctgcctcagcctcccatgtagctggggcttcaggtatgaaccaccacccctggctaattaattttttttggtagagacagggtcttgctatgttgcccaggctgaccttgaactcttgtcctcaagtaatcctcccacctctacctctcaaagtggtgggattacaggagtgagtcactatgcccagttaatgctagtattttagagtacaaactctggagccagacagcttgggtgcagtttctggcttctcaacttattaagctatgtgaccttgtgtaagtcatataacctttctgtgtctcaggctactcaagagtaaactggggatagccacactatctagctcatttgattgctatgattaaatgggtaagtacgtgtaaagcacttagaatagcgcctgtcatgtggttaagttagtatatatcttttagttgttgttagtaatgacttcaaattacttttaaaatgtaaaagcatatctggttcaagaagaagatggtgaaccagcaatagctgctggcttccttcccaaacccaaccctgcagatgccacagaagaggtgggaagtggttggagttcagaacagttcctgtaacaaaacccttgatggtttggccccactgggggatgagacggcttagagtgggaaaaggtcagaggccacagatggaggatcagcccaggtggagctttctaagttgcattcttgttttctccttgttttctggatggctcattacctgttgtgtaaacatataaagcagacacttggcagggctggcctagtgctagcccaaagtggcgtgataacattaaggaatagggggcttggaaagctcctaaaaaaaagtgcagactcatcaaagctggccagtaactgaacattcctttcctacctctccctctgccctctgagctaggcaattacaaccaatatcacccacccgtagactccctccactctgtaaggcagaaatcctgtaagtgtctctgggggctaataggctaggaactggaaagaattggctcagctcagctcagctctagaggctgtgtatcctatgacctatcaatccagaaaccctgaaactcacatgtagtgtctggggtgacacatttttcccagggacaaagagttatatagaaaaactatcagataggtcaggcgcggtggctcatgcctgtaatctcagcactttggaaggccaaggtggggggataacctgaggtcaggagttcgagaacagcctggccaacacggtgaaactctgtctcttccaaaagtacaaaaattagcccggtgtggtggtgtgcaacggtagccccagctactcgggaggctgaggcagtagaattgtttgaacccgagagtcggaggttatagtgagccaggattatgccactgcactccagcctgagtgacaaagtgagactctgtctcaaaaaaaaaattcctttctttcaacactttggagttattacaccattgtatccttgcctccagtgtggtgtttgagagacccgatgtcagtttaattatttttcctctgtaagtaacctgctatttctctctgatcgttttaaaactactttttctttctttcacaattttacatttcactgatcctgtgtgtgtgtgtacttacaatacctttaaatcttaagttatttttctaaatctgagaaattctctttcattacttatttaagtacactctcctgtttaatgactgtattctcttcttataaggctactattagatgtgttttgacatttattcttttatcctccctattaattaacttttatttcatttacttcatctgtatccattaccgattagttttatgaattctttagactcatttcctcaggtcagcaattgccttttcaattatatcagttttaatatccaacctatttcactgaattatttatttgagcatttaatgttttcatatccaatctatccaataggttatttatttttttatttatttatgatggagtcttgctctgttgcccaggctggagtacagtggcgtgatcttggctcaatgcaccttgcctcccgagttcaagcaattctcctgcctcagtagataattaaaaaaaaaaaaaagctgcatttggtggtgtgtacctgtagtcccagccactcaggaggctggggcaggaagattgcttgggccctggagtttgaggctgcagtgagctaagattgggtcactgcactctagcctgagtgacaaagtgagactttgtctctgaaaattaaaaaaaaaaagatcgtaggcacgattttactcagaagggggagtactatgagatgtacacgggccactgcaatgggtttttgtggtaggagagatattgggatcgacttggactccaccaaggacaagtggggatttatagtcaagagtagggttggggggagcgggatcagaagatgggaaattacttggaggagacatcaggtgcaggcggattctggctaaacagacttgacaggaattttgctgaaacaggcttaatgggcagagtccctggatggggaggtgtgagccacctcacctgaccaacaggctttgtttaatatgtcagttttcataagtaatctaggtataattgttaaaaatgaataaacgaggtaaatgtgagatacatgtttataaatgaacttttcatataattggaaatctttttttcttgctcttatcatacgaagatgaaatattaaagttgtgttatgttagattaagtaataggtactcactaaatattgggatcatttccaactaagaaaacagctgaaacaaatcgctaaacttaaatacaagtttgttcttggcccttaagttttataaaacacaaaagatatttggatccgttaataaaacgccctgttctacattgaaaattgttctggctggacttggtggctcacccctgtaatcccagcactttagggggcggaggcgggcagatcacgaggtcaggagatcaacaccatcctggctaacacagtgaaaccccgtctctactaaaaatacaaaaaaattagccgggcgtagtggcacgcgcctgtagtctcagctactcaggaggctcaggcaagagaatcgcttgaacttgggagccggaggttgaagtgagcggagaaggagccactgcactctagcctggcgacatagagagactccatctcaaaaaaaaaaaaagttacaacctgttctctctgaagcctagtacctgaaggcttcctctgcaaataagaactcaaaaaaaactaagaacgactcacttcaagtaatcaactttcacaatggttaaagcagagtcctgcttagcaatgcacaaaaattctcctttgtgatccattcattttacttctgttgactttcttgcttatgctttcagacagagtcactgtcctttgaccagacttgagtcgggctcctctgagtcctgtttctgactaggtcccaacctcgggctctgtctttcatccaggaactctgcccatttagcctgtttcagcaaaaatcctgtcaagtcagtttatccagaatccccctgcacctgagttttcctctaagtaatttcccatcttctgacccccggctcctactccctgactacaaatccccacttgtccttggtggagttgaagtcgatcccaatatcactctcccactgcaagaccccattgcggtggtccctatacctatcacagaagtccccgctctgagtaaaatcgtccttacgatctttttttttattttcagagacaaagtctcactctgtaactcaggctagaatgcagtgacccaatcctagctcactgtagcctcaaactccaaggcccaagcaatcttcctgccccagcctcccgagtagctgggactagaggtacgcaccaccaaatccagctatctttttttttaattctctgcagacccaggaacttgatatgcccgtctaatttttgtattttttgtagagaggggattttgccacattgcccaggttggtcttgaattcctgggctcaaccaatcctcttgccttgggctcccaacatgctgggattacaggcatgagccactgcagctggcccttccttacagtctttagtaagtgcaataaatacttgtttgctttaacatttccctgtgtcttcagtctcctgaagtgttatatgcctgacattgccgtactccaccaaatatagaaattcccttctttcgctgggtgcagtggcttacacctataatcccagcatattgggaggccaaggtgggcagatcacctcaggtcaggagttcgagatcagcctggccaacatggtgaaaccccttctctactaaaactacaaaaattagccgggtgtggtggtgtgtgcctgtagccccagctactcagaaggctgaggaggataatcgcttgtaactgggaggcagatcatgccactgcactccagcctgagtgacaaagcaagactctgtctcaaaaaaaaaaaaatcctttcg

SEQ ID NO: 1620 - DNA, 1550 bp, artificial
  synthetic oligo
agcccccagagacccttacaggatttctgccttacagcgtggagggggtctacgggtgagtgataccggttgtaattgcgtagctcagagggcagagggagaagtaggaaaggaatgctcagttactgaccagctttgatgagtctgcactttttctaggagctttccaagccccttattctttaatgttatcaggccactttgggctagcactgggccagccctgccaagtttctgctctgtatgtttacagaacaggtaataagccttctagaaaataaggagaaaaaaagaatgcaacttagaaagctccgcctgggctgattctccatctgtggcctctgacctttcccactctaagccatctcatcccccagtggggctaaaccatcaagggttttgttactgggaactgttctgaactccaaccacttcccacctcttctgtggcatctgcagggttgggtttgggaaagaagccagcagctattcctggttcaccatcttcttcttgaaccagatatgcctttacattttaaaagtaatttgaagtcattactaacaacacctaaaagatatatactaacttaaccacatgacaggcgctattctaagtgctttacacgtacttacccatttaatcatagcaatcaagtgagttagatagtgtggttatccccagtttactcttgagtagcctgaaacacggaaaggttatatgagttacacaaggtcacataccttaataagttgagaagccagaaactgaacccaagctgtctggctccagagtttgcactctaaaatactagcgttaagtgggcacagtgactcactcctataatcccaccactttgagaggctgaggtgggaggattgcttgaggataagagttcaagatcatcctgggcaacataggaaaacactctctctaccaaaaaaacaaatttttaattagccagccttggtggtgcacgcctgtagtcccagctacatgggaggttgagacaggaggatcacttgagctgaagaggctggggctacagtgagccatgattgtgctatggaactctagcctgggcaacagagtgaggccgtctctaaaataaaacaaaataaaatgctaatgcttttagccactctaccattctatcattcattagtgtcggtatccattccttgaacaacaaaagaacttctctttttttttcctgtccctcgtcccatcttccatgtttataatactgggaattttatttcaagactataattttttaagtttacaatcaaaagtttacactgtttaataaattttactatttttcttctaacaattgcttattgaaatcaccttcctcttaaatttacttttcttttctcatagggctgtataccaataattatttctgaagggtatatgtgtcattaattttctgaactattttttccctcattgtggattatcctggctgtatacagatatctaggttcaactttttttgtttgtttgtttttgttttgttttgttgttctgagacagtgcctggctc

SEQ ID NO: 1621 - DNA, 1600 bp, artificial
  synthetic oligo
ccctgcagctgtgcagcgagcctttccttgaaaaggggtctcagtggtgcacatttttttttgagacagagtcttgctctgtcgctcaggctggagtatagtggcatgatctctgctcattgcaacctctgcctcccgggttcaagcgattctcacgcctcagccacccaagtagctgagattacaggcgtgcaccaccacacgtctctactgtttttagtagagacggggtttcagcatgttgaccaggctggtctcgaactcccgatctcaagtgatccgcccgcctcggcctcccaaagtgctgggattccaggtgtgagccaccgcacccagccagtggttcacatctttgtctcccactgtcaggaaaggtatggggaggagctgtgaaaagaaatgggtggccactgggtaagtaactggggacccagggaaaatcctgttactcccatgactcgcccacatggtcctgagccagtcactttaccactctgtgcctcagtttcctcaagactcagttgagggttggggagtatatccattcattcttctgacctatattgactgagtacctacatgtgccaggcactgtgccaagttataacagtcaacaaggcacacaaaacctcgccctcagggagctgacattgccaagaacccctcaaatctacccagtgacccagactgagggcagatgtcacccctggccttgcttgcaatgatcatgacgcacagtgagcaccgtggcctcgttgcatattcagacagatgacagcctgacatggaagctgaggatctaatcagtggcatccacatggtaacaggaaggaaggagccactgtgggtccttgagcaggagcacggagatatcagtgcaaaacttcagaagggcaattccagtggcaatcaatagaaaaagacctttttactgcatgtcaccctgccccttaggtgagtcaaattaaggcaaatagccgaggccaggccaccctgtctgtcccctgttatatttttggttttggtttgtttatagctgagttattccctagtggtggcagtgatgattgggaatttggctttctgatctgaccatttggtgacttctgggaatgaatgaacggatgttggcagagaacagcaggagtcaggcatgttatcctgtgtctcttggatctcttgccctgtggctaacggtgtgaaaatgaagcattaagctccctctgtggctgcagtcagactcctggggtgagtgagtaatgttttcccatctctggagggtgtctatacattattttgtaatgtcacttgaattaaaggaactcagttctgattggctgatagagataaataagcacttatacaaatcaaatattcctaaaatttaggaaaatgaggaaatcagactttttaaatggctgtcctctgtagtccaggaagaaactgaacttttagtaccgtaaatgcactagtcttgaaaaagattcctccttcagaaactaattcagagactttaagaatccaagttctcataattaagataaatctttggcaaatgacattagtttaattatttgagtttaataaaaacagtatagga

SEQ ID NO: 1622 - DNA, 1650 bp, artificial
  synthetic oligo
tataatcccagcaccttgggaggctgaggtgggcagatcacttgaggtcgggagttcgagaccagcctgggcaacatggcaaaacccccatctctactaaaaatacaaaaattagccaggcatggtgccacatgcctgtaatcccagctactcgggtggctgaggcaggagaatctcttgaacccaggaggtggaggctgcagtgaactgagatcacaccactgcactccagcctgggcaacaaagcaagactctgtctcaaaaaaaaaaaaaaaagaaagaaaggaagaagaggaacaggagggaggaggagggatctgagctagcacgctcagccccttgccaagtgataccctgcactgtctcaggactcttcagagtcctcaccagcaaaaagtcccccaccagatgcagccccttgaccttagacttctcagcccccacaactgtaagaaagaaattcatttcctttaaaattacccagtttcaggtattctgttataagcaacagaaactggactaagacaggaaaacacaaacattcagtccattgccttccaacacctgcctgcccccgacaattcatgtgcttctcacatgcaaactacattcaattccatccaaacatccccccaaatcttaactcattccagtatgaactctaaagtctaaagccaaaagtctcatctaaagatcatctaaatcaggtatgggtgaaactcaccctgaagcaaaattcctcttcagctgcttaaaagaaaccaaagtatttgcttccaaaatacaatgatgggacacaaagagggtctataaacattcccattccaaaagggagaaacagggaaggaggacggggtgacaagtcccaagcaagtccaaaacctagcaagggaagttctgtgagatcttgagactcaggtaatcctctttggcttgaagctttgcctccagacctactggggtgtcagtccctcatgccagacccactgagggggcaatgtcaccctcacagtgagagacaggactagctggatttcctaggctgactaagaatccctaagcctaggtgggaaggtgaccgcaatccacctttaaacacggggcttgcaacttagctcacacccgaccaatcagggagtaaagagagctcactaaaatgctaattaggcaaaaacaggaggtaaagaaatagctaatcatctatcacctgagagcacagcgggagggacaatgatagggatataaacccaggcattcgagcccgcaacggctaccctctttgggtctcctccctttgtatgggagctctgttttcactctattaaatcttgcagctgcactctcttctggtccgtgtttgttacggctcgagctgagctttcacttgcagtccaccactgctgtttgccgccgtcgcagacccgccattgacttccatccctccagatccggcagggtgtccgctgtgctcctgatccagcaagccgtccactgctgctcccgatcgggctaaaggcttgccattgttcctgcatggctaagtgcctgtgtttgtcctaatcgagctgaacactagtcactgggttccacggttctcttccgtgacccacggcttttaatagagctataacactcacgcatggcccaaga

SEQ ID NO: 1623 - DNA, 1000 bp, artificial
  synthetic oligo
gctctcaggatccgcgttgctcaaactggccggagtcccctgcagggatgctccgcagggcaggcctaagccgcctaaggggctgcctcgaccatcgttaatcacctcgcttcccggtcagggaaccaagaaatgtaaggaagaggctttatttggtcaggagcgttggcagacatgcgtctcaagaacgaagcccccctaagaaagagttcctggcccttttaagggcttacaactctaaggggtccacgtgaaagggtcgtgatagattgaacaagcatggggtacatgactaggtgggggtggtgagcaaggcaagtgtttctccataccattgtctgtgatatatagatatcacaagcggttaggttgtgggttaatctttaacctacaggcctggccagtggtgccgatcagtctgttatttttcagtttttacttcctccttttctttggagacaggggacagtaggagaaatggcctctctcctcaatttcagccactcccttgtgggaactcccttactgctcatttttgagagattccagccatggttagacaggacaaaacactcaggcacatcatggtcaaaaatcttgaaatccaaagagaatatcttgcaagcacaaatagaaaaatgacctgtcacctataaggaaactccaataagattaagagttgacttctcatcagaaacaagagagcccagaagacagctaaaatcatatttaatggtgaaagactgaataccttccacctaagatcaggaacaaaacaagagcgtctgctcttgctccttctattcaatatcatattagaagttctagccacggcaattaggcaagaaaaaataggcattcagggccgggtgcagtagcttacgcctgtaatcccagcactttgggaggccgaagcaggtggatcacgaggtccggagtttgagaccagcctgaccaacatggtgaaaccctgtctctaccaaaaatacaaaaattagcc

SEQ ID NO: 1624 - DNA, 1050 bp, artificial
  synthetic oligo
caaatgacacaaaagacagagacaaaagaatattgtggctaccctttgagagagagatggatcagtaagaaatgatcaaagtcacacaaacccagagaactaacttcacacaaatgttttctcctgttaatctaaacttggaaaggagaaatttttaccacctggtcttgaccatagtctacacatggaaatctgggatgctgagttcaggaagaattcttaaccttttaccagtttggtctgggccccagagttttactgtagcctctggggtgagtcagggactttgttggttttgttctctgttgtatccctagcacctagaacagcactcaggcacatagcagattctcagaaaactctagttgaagaatggatgggagccaggcacattgcaaacatcactaagatgcacagatgtcctccaaggtgggcatttgaatgagactcagagaggacaggtgaattccccaaggtcgctgctatggtttgagtatttgtcctctccaaaatttatgttgaagtttaattcccaatttggtagtgtggagaggtaagacctttgaaaggttattgggtcatgaaggctctgccgtcatgaatggattaatgggttaatgaattaacgggttaccatgggagtgagactggtggccctataaaaagaggaaaagaaacctgaactagcacacttagcctccttgccatgtgatacctatctgcactgcctgaggactctcagagagtccccaccagtaagaccatcctaaccagatgtgccccctcaaccttgaacttagcctccagaactgtaagaaataaattgcctttctttataaatcacccggtctcaagtattctgttatagcaacacaaaaccactaagacaccaggcaagtggaacagcattgacttacccaagaagagatactgggctcaccaggtagcatcagtttagctaattaattatgaacagtcttggtgttgttcaggtatttagtgccagggatgtgctaactgcttttcaggtattttctaacttaattatca

SEQ ID NO: 1625 - DNA, 1200 bp, artificial
  synthetic oligo
tttccagcagaatcaaagtgtacatttatgtacagactttattagagatctaatgcatcactgaggcattgcatcaacaccagattcatattaaactggatataaaaaataagttaatgccagattacaactgcctagcagggcaacttgcaattgccatacatatcacagcaagtttacagcactctagctaattagtatttagtccaaaatacataagaccaaagttaatactttcattccgtttgcaaagcgaggttatatcgctaataaataagcttccttagaactccaaagttgaacagggtacaaaagaatatcttcatgatgttgtaattcatagatctgggaaaccagaaggaaggggtatgggggcaaggggtaggaggccaccacaggtcgtattctgaacaggaatgaatgctatgtttccagcccaagctgctttaacttgtgacgatctctttgctgtcctccatgaagcgggtgaagcggaattggttctcttctaattgcttgccattttccccaggccggccagagaagcagtgggctctgatttctggagcttctccagatttcctgtcagcccactaacaggtgagctgttcccagtgtcgaggcttccaggaattggatggatgccaccattctgaatgacggaggtcccgttgcccttcatcgccaacccgttggaatgccgtgctgcattctgattccagaagctggaaggatccccacttcctgatcttgccaccaaatccttatggaacatttctgggaacttgatgggattgcctcctagaaatgtcatgggcccatccccagagagctgcctaccctgtcacacaggggtgctattccacatgtgagtgcccgtgtgtaccttttgtcgtgaaagctcttccacaaatagtacaagcaaacagtttctctccaatgtgagttctgccaggcactcaacgagggggaggttttgccacatgtgttgcagtagtgctgcttgggagttctgggcagagccaagagcagaactggagatgtggcagagaaagacagaggcccagaagggatgtgactggtggggtgtccttactgtcctgaggagaaatatgcacaaagccgttgatctccgttttgctgagagatgacaacgagttggcgggaatcaccacagagttctgattggggccaagattg

SEQ ID NO: 1626 - DNA, 1200 bp, artificial
  synthetic oligo
aggacaattaagctgggtctggggcttagtcatttattcatgagcatttaaaaagtatttctcaggttatttaaatgcgtatctggtgttgaggatggctagtttagaacatatattaccaataggcctttgacgaagtgttcagagcagtgagaaaggtaagatgtaaagcttttaccatcttaaagtcaaccagcttattggagatggcttgatcagacacttttggaagaccctgcttgagataaatcaaatataagcaaagtagtagtagatgttgaagcagagacagctaaagggacattagagctgcaatttagggcctttcagggttcccccagatgattaaaactaaccagaggccataacaatcatcttttctaagactatagagagaataaaagcagaaggaaagggagaaaaaaaccataactattttttaaacctttcctaaacccttagcatattttgtagtccttactctatcacctgaactagtctattttataaagcggcctggataacctttaaagtcctctatgtgggtctctatcagcatttgccagtcataactaatggactgagatagaagacacagaagctgtgcctgtagaagaacataagacaatgacaagagaccaaaagcaggtccattttgtacagctgcctgggggtgtacatttaggaggactgcaaaagttagaagacataccttacttattaaaagtggtaactagaaaatgtgcccctaaggaaaatcagtatttttttaaagtataccattcagtatttttagtatattcacaaaagttgtgcaaccatcagtactaattccagaacattttcatcacccctaaaagaaactctattttctgtctttatggattttcctattctggacatttcatgtaaatggaattatacaatatgtagccttttgtgtctggcttctttcactttgtgtaatgttttcaaggttcaaccacattgtaccatgtattagtatttcattttttattattgctgaataatattctattatattgatgtaccacattttgtttaccaattcatcagctgatggacatttagggtctttctacttttttggtcaccgtatataatgttgctgtgtgtatttgtgtgcaattttttctatggacatatgttttcatttctcttgagtatacagctaggagt

SEQ ID NO: 1627 - DNA, 2000 bp, artificial
  synthetic oligo
ggggtatgaagaaaagaaaaggaaaatgatttggggatggctgcaatttgtaacaagtcagtgtgccacaagacatcttggatatgctgcctgtagtgggttgaattgtgtccccccaaaatatatgtccaagttctggcccccagtacctatgaatgtcactttatgtggacacagggtctttgcagaggtaactaagttaagatgaggttattctggattgagagtgggccgtaaatctaatgattggtgtctgtatgagagaaaggagagggaagattgagacacagagacacagtagagaaggctgtgtgaagatagaggcagagactggagttaggttaccagaaaccgaggaatgtctggggccaccataagctgaatggggcaaggagggattctctcctagagatttcagagggagcatggccctgctgacaccttgattttggacgtctggcccccagagctatgagaaaataaattttggttgttttaatctatcaagtttgtggtaatttgttacggtagccacaggaaactagtacgctgcttaaaaggaggacatttattcaggcatcaacatgtccagagaaaacggcatgcgtatttgctagtattttcccatctggtgtgtccagagcatcaggagaggcaggaaccctcccagcagccatctggtctctctacctggctccaggcagagctggcacctgtacatagatggtcccatcccatgcccaggttgcatgtgatagaatttctgactgtgatgtgttacatgcgggcatctgtgtgcctcctcatatgcaggtagaataaacacactgccctttaaatgttctccaagcaaggtctggcccaaagcacaatggcaggtgtggtcattgtatttccgcaggtgcatgaattaccacttaacacagtgttaagaaatagctgattttcttctttgactaaaagatttcttgaaattgctttgataaaataagatcaacactaattccctttttatgcattgtgcctatcaattgaaatggaaaaaagaaagccactgccaactttcatttatttaaatgcatggatagatacatgcagatatttatgatttctccctaggattcacagatgcaaatggaaaggaaaagtcgcaatgctaagtgtacgtattttgtggggaagacaaataagaacaaagcgctgcttgctcagatggacagctctgtgtctccgcctacagggctctgggtgtctgtgcaccagggggaacctgaagtggccgcctcttcacaacctctattccatagacagttgcttaccccaccccttgtcactggcataaaatcacttgaaatatctaacacctaaaattgctaaaatgcacagtggacctatgtaacagcgatttatgcctatgagggcctgcatccaaaatgaacaaggagagagctgggctgctgtcagtgttattgtggctcattgtctatgcacaaactgcagtgctacagaagcaggtagcatttatggccttctgtttgtttgctgtcactttggtacctcagctctgaggtttcctttgaggaagagggagtggaatgtatggaagttttgacagagaatttaacctcctcttcttagagagtttaaggggctactctctagaatgatcccgtctgacatttagataacactggattctgttcatctcttgcagaggaacttaccagcagggcctctgtccaaatgcaggaaacatgaacagaatccccagcttgctttctcccacaggactctgagaaataatcatcctgtacatgctcccatttgacgccttttaatggaacaaattcaccattggaaatatgcaggaagttgatttcttttatattttgccatctttaaccaatccctggataggttttcaaaatctcattgaagagaaatatttggatgagattggggaagtggaactcaggtttctcttggtatttataattggg

SEQ ID NO: 1628 - DNA, 1150 bp, artificial
  synthetic oligo
gtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagc

SEQ ID NO: 1629 - DNA, 2700 bp, artificial
  synthetic oligo
attttcaaataaccaatctattgctattgagtataaccactatgacttacaatagctcccttgaacttattccccctgtctaacagaaattttctatccattgccaacactccctatgccccccaacccttaacctccagtagccaccatttgtactctctgcttctatgagttccaattttgagactccacatataagtgagatcacttgctatttgtctctctgtgcctggcttatttcacttgacctcacatgctccaggttcattcatgttgccacaaatggcaggatttctttcctttttaaggaggactcatgttcctaccacgtaccccacaactcggggagacaacgtggctccgcctgagttcctcctcccgccagtaggctgagacaggcgtgcggctcgacatgtctctttcttctgtcttgcagatagctctcttccattgcattaggtccaatatcttggaaaccattgtcatctcggttatttcgttgctttgcgggggaaggatcaatgtggtgtttttttcctccaatgtagccagaaatgcaatctcctgaaacatagtttttaatatcccatacttagcaagatcttattcaggttggcagaaagaaaatgggaaagagaatgttcgtcaaagtgtctctaggcaagattttccagtgtgcaagaagatatactcaggcaagacggtttttccggtggacacccttgtgcctgcatgtgatactggaaatacttattttagagatgcgagtcctaaacaactatctctgggatgccgggagcaaactccctgggtcttctagaggcaggaatttgccaccttgtgatgatgagagtttatctcagagaccatgcggctataatttggttttccccagctggtatctgcagctccccccggctgttaacaatttctccaatgtccactcctgggtccgaagtcactgttgcttacatcttttacatcctgacccatgagaacagccttcgctcacttcaagtctactatttaagtgagagacagtgatggcatcaaccccaccaaccgcacacctcacattgggaagagcatgcagactgtgatagtggctcagagtcaagtctcaggaattgtggtggagtcacagaaactgtggtgccattcccagaaaaaccttgatcctggtcataatagaggaggggaaaggtattagggtaactcattgaggcacttactgcggagtcccaggcaaaagcgatagggtctaggtccctttggtccaaatatcggggtataatgacataagttatattaggaacagtggatgacatttcttgacaatttgacgcatcagggcatggagctctatattctccttccagcacttcacttaaaatgctcagcaaattaagatatatgtaattctgtcgccgttgtacagatgaggaaaccaaggcccagaacggtgtactgacttgtctgacagagggtgccctatcgctgtgctcctgcaggaccctgtactttgctgacccgtgcccccgtcacacagttttgaatggaaaaggctatctctgttcctcacgccatacattgggagacgacagtgtctagggaaagttggaacttaataaggaactggaaggcctatgttcttccctcctcctactttttttgtagctgaattgctttacgctcagtttttacatcaaagaaatgtggatgacggctcctgagatagtggtcctggaagtactgcctacacctcaggctgtgtgcagttaagacaaaagctgcatttggatttttgctcaaacaacaagaagacgaataaaaagggctcatatgcagtaagtgcttatataggctaggctccatcattccttcatgggcatgctctcactgaagcctcacagagaaggtgaatgcaacttttaaaacttgttgccatttcaggcaggaacaagtagcagagttgggacacaagcccaggtggatatccgttcaaagcctctgtcctcaaaataagtgttttccaaactgtgatatgcaggttgtttgtggccatagacacaagtatattggcacatgaagaaacaacgtgggggctcatgaaatagcagaacatccaatctacggtcatttcagatttttataggaggcccgcgtcatggtggcgtgcactgggcagctggccacaggatctcggccagggatgaagagctgcttttgatgtgaggaggagatagggtgaaatgcgtagagagttggatccatgaaaacagagaggggccaggatgaatggggcagaagtgcctgagagctacttttttccccagtccttactgaccatggtatccaatcaccctggctttccaacttcttcctgccacctgccctcttggcatccatgggcttggtccttccattatcagcgtctcagtttctttctccaccaattgagattaacaataggtgttctgaaagactttagtgagaagtaaataaaggaacacacgtgaagtatttgtgagagagagagagtccttaggtctatttcatatttttcattttcaaaggcacatgtacaaattatgtatcacacctgtaatctcagcactctgggaggccgaggcagtcgggaagcttgagctaaggagttcgagaccagcctggttcacatggcgaaaccccgtctctaca

SEQ ID NO: 1630 - DNA, 1550 bp, artificial
  synthetic oligo
cttgaggaaagagcaagttgaggaatggggtttaatctactcgataccggttatacagcgagcaggcggcaggtccaggattcaaacacaggtagtgtgtccccagaggccaaatgtgtaaaccctctgctaattcccctcatcaaaaggtaggggaccctggggaagctttctctactacaaaagccagagtcaccaccaccttctgaaataatctgagaccaagtaccttcaaaaaccaagccttgccatacatagccaagccggactttatagacacaccaacacacatagtttcctagaaggtatttactgatttctatatacttaacacatgtacaagacaggtatttcaaaagattaaagagggcagacagtgcgcagatgtctttctcattcctgtgtgcacagatgtctttctcattcctgtatccccatctccttacccagagacacttcccaaacaacaagcgaaatagtaacagctttcgctgttacaggaaataaagagtaatgaggtatgtaacacgaccaaatcttgaaatatatcatttaaaaaccagtaaatagcataactcgaatctaagcagtgaaaatatgaacgtctacctgaaactcacaggtgcgggagcccacgcacaccataatcaatggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtcca

SEQ ID NO: 1631 - DNA, 1300 bp, artificial
  synthetic oligo
aatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaactatgtgtgttggtgtgtctataaagtccggcttggctatgtatggcaaggcttggtttttgaaggtacttggtctcagattatttcagaaggtggtggtgactctggcttttgtagtagagaaagcttccccagggtcccctaccttttgatgaggggaattagcagagggtttacacatttggcctctggggacacactacctgtgtttgaatcctggacctgccgcctgctcgctgtataaccggtatcgagtagattaaaccccattcctcaacttgctctttcctcaagaatgttaacagctaacagagtgtttgttcttggggtaaacacagtgccttgccttgactacctgatccatgaatgcttgttttctcaatttcaggcccccaaaactcctcctatcaaggcacccagacaatatgaaaccgcattgtttaggggcgtccatacacatgggaaaaccatgaattaggcagtgaaataatttaagccagcatcagattagggtttaactctatggaggaggaatggctttgagtgggggtggggggaggggagggtgtcctgcattcctgttcctcttgctgtgtaacaaacagccccacagtgagtccatacaatgacgagcgttgtatcatatgcatggaatttcagaggcaggaattca

SEQ ID NO: 1632 - DNA, 1800 bp, artificial
  synthetic oligo
aaaaagtaggaggagggaagaacataggccttccagttccttattaagttccaactttccctagacactgtcgtctcccaatgtatggcgtgaggaacagagatagccttttccattcaaaactgtgtgacgggggcacgggtcagcaaagtacagggtcctgcaggagcacagcgatagggcaccctctgtcagacaagtcagtacaccgttctgggccttggtttcctcatctgtacaacggcgacagaattacatatatcttaatttgctgagcattttaagtgaagtgctggaaggagaatatagagctccatgccctgatgcgtcaaattgtcaagaaatgtcatccactgttcctaatataacttatgtcattataccccgatatttggaccaaagggacctagaccctatcgcttttgcctgggactccgcagtaagtgcctcaatgagttaccctaatacctttcccctcctctattatgaccaggatcaaggtttttctgggaatggcaccacagtttctgtgactccaccacaattcctgagacttgactctgagccactatcacagtctgcatgctcttcccaatgtgaggtgtgcggttggtggggttgatgccatcactgtctctcacttaaatagtagacttgaagtgagcgaaggctgttctcatgggtcaggatgtaaaagatgtaagcaacagtgacttcggacccaggagtggacattggagaaattgttaacagccggggggagctgcagataccagctggggaaaaccaaattatagccgcatggtctctgagataaactctcatcatcacaaggtggcaaattcctgcctctagaagacccagggagtttgctcccggcatcccagagatagttgtttaggactcgcatctctaaaataagtatttccagtatcacatgcaggcacaagggtgtccaccggaaaaaccgtcttgcctgagtatatcttcttgcacactggaaaatcttgcctagagacactttgacgaacattctctttcccattttctttctgccaacctgaataagatcttgctaagtatgggatattaaaaactatgtttcaggagattgcatttctggctacattggaggaaaaaaacaccacattgatccttcccccgcaaagcaacgaaataaccgagatgacaatggtttccaagatattggacctaatgcaatggaagagagctatctgcaagacagaagaaagagacatgtcgagccgcacgcctgtctcagcctactggcgggaggaggaactcaggcggagccacgttgtctccccgagttgtggggtacgtggtaggaacatgagtcctccttaaaaaggaaagaaatcctgccatttgtggcaacatgaatgaacctggagcatgtgaggtcaagtgaaataagccaggcacagagagacaaatagcaagtgatctcacttatatgtggagtctcaaaattggaactcatagaagcagagagtacaaatggtggctactggaggttaagggttggggggcatagggagtgttggcaatggatagaaaatttctgttagacagggggaataagttcaagggagctattgtaagtcatagtggttatactcaatagcaatagattggttatttgaaaattcgtaagacagtagcttttaggtgtttctacccacaaaaaacaaacaaacaaacaaaaaactgataaatatgtgaagggtggaatatgttaattagtttgatttggccattccacaacatatacagata

SEQ ID NO: 1633 - DNA, 3600 bp, artificial
  synthetic oligo
cagtcactcttgtcttccacctcagcaaatctaaccactcttgtgacttttaacacttgacgataatcctgcctgtttgtgaacgcattacacatgagtagactcagtacagtacgtattttataatccgggtttctcttggcaacattaggtttttctccttgctattcacttttgtcgtgctgtgtagctgaatttcgtttctttgcattcctgcgcagtgttttgaattgtatgacgatgccacaatttattcatgccttttatttctaatgggctcttcagtagtttccagcgctggagtgttagtgttattattgtggtgcacgttcacaaggatgtcctttggttaacatgcgtatgcatttaaggctgtgcttgcaggactgctttgattactttttcttccttcatggcactgtaagtggtgacagtggatgtatctggtttttttttccccctgatctcagagggaaagctgtcaacatgtcacccgtaagtatcgttgtttttgtaggcttttaaaatatattccaacggaatcaagagacttcccttttgttcgtagttggctaagaggttttatcataagtgcatggtcatttaaaaaaaatcaaacccatgaaatacccttcctgcgtctgtagggaatatcatattttttctccttcatacattacttctgagagatagatttttcaagcgctgaaccgcttcatttctagaatactcttgacttgtttgtgatacgttttcctttttggagatttaactgatttgttttgctaatgctttattcaagatttcttcttctgtgcttatgtaaaagataggcctgtgcatttcatttcttaccatgccctttaaggtttttccctcataaaacgggatgggaagcatttcccgttttttatgttacttggcaagaaggtaagattgatattccttccttcacaaacgttttgtagaattaatcggtggcagcatcagagtccgtaggttcttgtggctgttgctgttgtttccttcagattccgcccgtttagaatttgtaggacaattcagatgtttagtctgttttctgtcattttgttgtattttcttgaaatgtgtaaattatatccaaagtttcacgtttgtgggcataaagttgctcatggttttgaataatgatctctttaatgccttcattgcccatagtgatgtctccttagccactccagacacgggttgcttcatgatttctctcctttttgttcaggcctacacaaggcatgtcttaatcacatcatcttttcaaaaaaccacctctggctgtgttgttttatctttaactgatttgtacttttatcgttatttcatttcttctgctttcttcaggtttaatctgttgttcaacatggttaagaaagatgcaaatgttgtgcctttctttttcatgcaatctagacaattaaaatatatcccataagatttcatcaggttcaaaatactttgcgatttcattggtgatgttttccttgagctatgggttatttagaaaataggaaataaaaaggatgccttttctaaaaataaaatgaagtgaaataaaaaggatgcccttttatttcattttcttgcttaattgccctctgaacttccgggactatgttgagaagaagtagcaaaagcgggcatctctgtcttgctcctgatcttagaggaaaagctttcactctttcgccatcgtgtacagtgttcacaatgagtattttatataggacttttgtgacgttgaggttgtttccttctgtttcaaggagtttgagtgtttttatcacgaagggggttgacttttgtcagatgcttttagtgcatcaattgagccgatcatgtggttttgtccttcattttgttgatgccgtacactaaattagttgattttcattgatcgaaacttccttgcattccacgaataaatcccacgtggtcatgggcctttcatgtgttgttgaactcggtgtgctagacttttgttgaatatgtatgcacaaacattcttttgggaagtgtgtgtgtgtgtgtgtgtgtgtgtgcgcgcgcgtttctggtcctagttcttctctaactgtttagtagaattctccactgaagccatctagtcctgcggttttctctgttgggaggttgatgaatactggttaagtctccttatgagttgtcgagatctgctgagattttttatttcttcaggagtcagtcttggcagcgtgtacgtttctcagaatttatccatttcttctaaagtatcaaatttgttggggtatagttgttcctggtcttctccttataatcttttttatttctgtagtaacaattgtaatgcccctctgtcattctgattttagttatttgacccttctctgtttttttcttaatctgcttaacctatgttgaccttttcagagacaccagctcttagtttcattgttttttttttcctattatttgtctattctccatttcctttatttgtgctctaatctttattacttccttccttctgctaacttcgggtttacgttgttcttcctttgctagttctcgaaacacaaagataggctgttgatttgagatctttcttctttttcactgtaaggatttaccacaataaacttccctcttaacactgctttccctgcatctccttagttgtggtatgtggtgttttcattgtcatgtgtctcaagatactttctaatttccttgtggtctgttctttgacccactggttgttgaagagagtgttgtaatttccacctgtttgtgactttttcaattctccttccggtattgctttctagtttcattccattgtggtcagaaaagataattggtatgatttcaaacttctgaagtttgtgaagatcctaaatgtcaacaaaaaagctaaagcataagacctctggaagagaattcaggataaagccttgaaaaacttgctgtaggcgaaggactcttatagctatgacacagaaagcaatagccatgcaaaaacaccttaagtgaatttcatcaaatttagaaatctggcttttcatcattagcgaaatgaaaaagcaaaccattcattgcggcaatgtttgcaatatatactacccgacaatggaaaagtttgcacgcaaaaaagcactcttataattcagtattaagacgacaaatgataatcaatgtgcaaaccatgtgaatggttcttcacatgcaacacggaacgatatgcaactggtcaagagaagaggctgggccaaggtcactagtggaggcagcggcaaagctgggtcagagatctcaggcaagtcacctcccttctctgagtctgtttcctcaagtgcacagtagtagctcagacgatctttgagggtgtcacgaggtagtgggcaaaacgcccttggcccagggcctgatgacgacaaaaacaaggaggagcagcaggatggatgcccaggaaggaaagcacccaacctgatgtctcaggaggctgggagggcggtggcaggcctcagaaacctagggtggaacctgtcgttcagggaagccgtgaggggtagcgaatcatgc

SEQ ID NO: 1634 - DNA, 1250 bp, artificial
  synthetic oligo
aacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaatttggatgtttcttcctttacctgcacacccattgctatacctggccacgcttgggcttgtagcaaggaaacttcttcaggctctctggggtaggtgggccccacctctgccaaaaaggcccacagggacaggtgggatgctgggaggtgcggaggttggttacgcctgagtgcgtgagcaggagtttggagaggccccagtgctcatcgttatgtgattttctacaaaccttgctcagcagccccagggacatggcaagagtcggggccacagcaggggcggggtggaaaattgcagcttggtgccactgcccctcccgccgagggacagggtccaaggctctcaccaggacccacctcccacaccccctccttggagatgatgttccggaacccttggctcatcatccacacagttcaggaccccgtcctcggtacagagtctgacggacaatgaggtgggccccgcagtgatgttcgcagccctccagtgggtagaaggaggggccgtgattgctgagggagcaggatgtaataaaaacaacgcacggtgcacgcgtacacagccccttgcctgtgacggaacggcggcctgtttggagcttcgcagcccttctcccccagcagcagggctctcccagtgaggacaacaccaggcctacctaggtcctggtgtgttcaagggctgggtgatgtctggaggggtctgaggtagggctgcacatgcttcaggtacaagacagtgagggcagagacagtttggtctcctgggaagggctcagtggcaggcagggacagtgtccagggcttctggagttccccggtaatgtccagggcttgggaggacagagccctagataaggagggaaaacatagcagtggaaggctccctgcttcccaccccctcacccagccccagcctctgtttccccagga

SEQ ID NO: 1635 - DNA, 2150 bp, artificial
  synthetic oligo
agcttttcctctaagatcaggagcaagacagagatgcccgcttttgctacttcttctcaacatagtcccggaagttcagagggcaattaagcaagaaaatgaaataaaagggcatcctttttatttcacttcattttatttttagaaaaggcatcctttttatttcctattttctaaataacccatagctcaaggaaaacatcaccaatgaaatcgcaaagtattttgaacctgatgaaatcttatgggatatattttaattgtctagattgcatgaaaaagaaaggcacaacatttgcatctttcttaaccatgttgaacaacagattaaacctgaagaaagcagaagaaatgaaataacgataaaagtacaaatcagttaaagataaaacaacacagccagaggtggttttttgaaaagatgatgtgattaagacatgccttgtgtaggcctgaacaaaaaggagagaaatcatgaagcaacccgtgtctggagtggctaaggagacatcactatgggcaatgaaggcattaaagagatcattattcaaaaccatgagcaactttatgcccacaaacgtgaaactttggatataatttacacatttcaagaaaatacaacaaaatgacagaaaacagactaaacatctgaattgtcctacaaattctaaacgggcggaatctgaaggaaacaacagcaacagccacaagaacctacggactctgatgctgccaccgattaattctacaaaacgtttgtgaaggaaggaatatcaatcttaccttcttgccaagtaacataaaaaacgggaaatgcttcccatcccgttttatgagggaaaaaccttaaagggcatggtaagaaatgaaatgcacaggcctatcttttacataagcacagaagaagaaatcttgaataaagcattagcaaaacaaatcagttaaatctccaaaaaggaaaacgtatcacaaacaagtcaagagtattctagaaatgaagcggttcagcgcttgaaaaatctatctctcagaagtaatgtatgaaggagaaaaaatatgatattccctacagacgcaggaagggtatttcatgggtttgattttttttaaatgaccatgcacttatgataaaacctcttagccaactacgaacaaaagggaagtctcttgattccgttggaatatattttaaaagcctacaaaaacaacgatacttacgggtgacatgttgacagctttccctctgagatcagggggaaaaaaaaaccagatacatccactgtcaccacttacagtgccatgaaggaagaaaaagtaatcaaagcagtcctgcaagcacagccttaaatgcatacgcatgttaaccaaaggacatccttgtgaacgtgcaccacaataataacactaacactccagcgctggaaactactgaagagcccattagaaataaaaggcatgaataaattgtggcatcgtcatacaattcaaaacactgcgcaggaatgcaaagaaacgaaattcagctacacagcacgacaaaagtgaatagcaaggagaaaaacctaatgttgccaagagaaacccggattataaaatacgtactgtactgagtctactcatgtgtaatgcgttcacaaacaggcaggattatcgtcaagtgttaaaagtcacaagagtggttagatttgctgaggtggaagacaagagtgactggcatgagagtgcttttgagctgccggcaatacactacaccatttcttaacccagatcgtaggggatcagacgtccctgtggaaccatttactgagtggtaccctcattttgcgtgcaactccatttttgtattatattccattacagtgtacatagagatatttaaatgaatactatcccaggaatgtccataaacaatggattcttcagcgatttgtatattctctgaccacaatgccacaatgggatctagaaattaataacaaaagatcattacaaacccccgtatatgttggtaaattaagaaacatcctcctaagtaacccatggctctaagaaaaactaacgttgaaataagaaaatattttgagcttactaatgaagcaaactccagaggtctttgcctgccaatattactaagtctcctctctggggaa

SEQ ID NO: 1636 - DNA, 1150 bp, artificial
  synthetic oligo
gctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattca

SEQ ID NO: 1637 - DNA, 1250 bp, artificial
  synthetic oligo
agctcgtggatgctaggcttaatacctgagtgatgtgatgatctgcgcagtaaatcatggtggcactcatttacctatgtaacaaatctgcacatcctgcacacgtaaccctgaacttaatataaattttggaaataaaaaagtcagtatctcagaatccctctttccatgtgtttgtcattatgtcatttatcaaagcagtatggtgacataaaagctcaggtgtaataacagttagtatgattagtgatttagcaggattatagcccagtaattactaatattgaattgcattggactgcttacagtacttaaggaaagttggtaaggaaaaatattcatgcttcaaaataattttaaaattcatgtaaaattgatcaacactgaataccacagatgtcgctgtcactggatgctaatgaagtacataatggacccataagacacagtcaataataaagggggaaataaaagggaacatatcaaagcaccatcagactagtgcagaggcacacacatgaacacaccctgcagctgcggaaagacatggtaggaagtaaagccccacaactcatcagccatccttctcaccagctcatgagttcacaaatgagtttgctgagggtcaaatgtctacagtaaaactgaccgatttaaatatcactgaatgccatttcaagccttaggtagaaagctacagacaagagtgaacttattctgagcaagtcttaatccatcatcttcacagatggctaacagaaatggcctgtaaatatcttgtctgacaaccgctaaagtactgacatccaaactcttttattacaatgcatgagagtgttgcgggaaaatcagagatgggagagacggaacagagttcaggagagccctttattattaaggtgatcaccggctcagtcggactagggtccagaaagtctgagccccgaacaaagggatcaatcaccttttaagtagtttgtggcgggagttacgtgctgcaggaagcgtacttgtggaagcgagaacaaaggcagttaatctttctttcacatttgttgcaccacatgtcttacatccttgggaatacatgtttttgtagcatttgcttatcaaccttgtgacttcacagccgcgctagggagggaagaaagaactcgctgtgcctcaaggaatgtgaaatgatggaacacagataagcctctctgagcatagaggagaaataagcagttaatattctcttttaacccagg

SEQ ID NO: 1638 - DNA, 1150 bp, artificial
  synthetic oligo
gatgtcctcctctctgttccatcagggtgacaactgtatggggcacctgaattatcaacttctgtccaaaagtgagcttgttagcatcctcagctaacagagcagtgacagccagcaccttgaaacggggcggccatcctgtggccacccagtccagttgcttggacagatatgctacaggtagataccatgaccctaacatttgcaccaagactcctgtggccatctcctttctttcatgaacatacagataaaagggctttgtcaagtctggcaacccgagtgccagagcttgaattaaagctttcttgatttccttgaaggccatgtcctgttcttttccccaaaggaggggctcctttatccccactttggtagcctcatataaaggttttgctaagagcaagtagttggggatccatatacggcagaaaccagccaccccaaggaactcccgtacatgccagtgtcgtgtctggccaaggaatgctacacacagtctcttttcgctctcgcacaagctcacgccgcccttggggaataggaaaaccaaggtactgaactccttggccacagatatgtgcctttttcttagacactttatagccagcctcccacaacactcaaaggagattctctgtcccttcgatacattcctttctagtgggtgcggccaacaataaatagtcaatatattgcagtaagatacaccggtcactaggtggcgtgaaagccttcaagtctgagacaagcccttcctcaaagataggggagttcttaaatccttggggaagtctagtccaggtatactgaggtggtccccactcaaaagcaaagatgtctcagctcataggggctaactgaatgcaaaagaatgcatcttttatgtccaggcatgtgaaccaagcagcactagcaggcatttgtccaagcatagtatacgggttaagtacaacagcatgctgtgtagccgccaccttgttgactgcctttcagtcttgtacaggttggtagtcaccagacggttttaacactggcagcaagggggtattccaggaggaggtacattcttctattatccagaactcaaggagtctttttaaatgtttttcaattccccaataggcctccatgggaatgagatattggc

SEQ ID NO: 1639 - DNA, 1950 bp, artificial
  synthetic oligo
gggcttgaccaggactcatggcaatggggaaaagcatatgggagatgcttatactggtacttggtgtgtctgtgtgtgtgtgtgtctgtgtgtgtgtgtttgtgtgtctggtgtgtaaatgcagaggggaaaatcggaaattaaacactcagatctgccctcagtagtcacatctggggagagaggagggtagtgctgttctatggagagaatacctgactatacttgctttctgaggtaggtgcatggatacacaaaccgaaatacacattaagcatgtcttgctcatcaatgaaaacgctaatatctaacagaatggcacactgtaagaaaatacaatggaaacactaacatcgaactcttgtcacactaagaaaaacgacgctcaacttttcactgttgtgaacacttgctttcacttgctatgcacctgatgacgaggggtccgcagccatgcccatgttcgtgaaaggtcaccacgttctgcttctcatcatgggcatatgtcgtatccccgaggctgaggcaagaagagagaaggaaagtaagtggcagtgagttcccaccacgtgacaactcaatctcaactcctcctgacctgcagaccctgcacactctgattctgccctaccccaggacctgcacacgccttccatggttccttgaagtgaaccatccgctcatgccacagtgacttcttcgcctgggttatccattcctaggctagaggaaggtgtggcccacatacagggctgatctggagttcgggaacccacagcatcctgggtagggagcattcctggatatacagggcagggagtaaaaagagcttacgaaggccaggcgcggtggttcacgcctgtaatcccagaactttgggaggccgaggcgggcggatcacgaggtcaggagaccgagaccatcctggctaacacggtgaaaccccgtctctaccaaaaatacaaaaaaaattacccgggcgtggtggcgggcacttgtagtcccagctactggagaggctgaggcaggagaatggcgtgaacccgtgaggcggagcttgcagtaagcggagatcatgctgctgcactgcagcctgggccacaaagggcgaatccgtcaaaaaaaaaaaaaaaacgtgggaaatctctcatcattcggcctcaatgctgtaccctagaaaattatgagacgggaatgatttggggagcaagtgacagatgggataccagtatcataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctccttctgttgtggggtttagattcccaaccttttcacttacgggaacatccacccttacctcctttcattcagcacgtgtttttattgagggcaccgaggcatacttttttttattgcacaacattttcatagtgcttcacagatgctgcaatgtttttttttggaaactctcatcaattttacacctttccgttattattatatctgttatagtgatctgtgatcagtgagctttgatattattactgaaattgtttttgttgttttttagtcttttaaaataattttaattttttaatttttaatttttattttattttattttgtttgagatgaagtctcgctctg

SEQ ID NO: 1640 - DNA, 1850 bp, artificial
  synthetic oligo
ccttggcatcccaaagtgctgggacggtaggcgcgagccaccgcacccagctataattagcaatagtagaataaatttagtttgtacaatgattttgaactaagatcccaagcctaagggccaccagctaaacaaatcaaaagactatgggggaattgaatgagacctcttatagtctttgagtagcatttgaggactgggttgaattaaagcagagtgccaactctataaaagggaccactctataaaaaggattcactaggtgaatcaaaggatttgggagtcatggtctgccaagtgaaaaatgtagacattaaggggataagagtctcattatgatatgaagacttattctgatatcttgggaaaagctgtctacaatgtggaatcgtcagcttctcatcctgatttgtcgttcgaatgtctctggttatggcattcgacagtttggtgaactttttgtgtggtccatgcatcagacacgagacttgttccttaaaatgtatgcagtttggctaggtgcagtggttcatgcctgtaatcccagcattttgggaggctgaggtgggcagatcacaaggtcaggagatagagaccatcctgggtaactcggtgaaaccccgcctctactaaaaatacaaaaaattagccggggatgttgtcacgtgcctgtagtcccagctactcgagaggtttgggcaggagaatctcttgaacccgggaagcggaggttgcagtgagccgagatctcaccactgcactccagccttggcaacagtgtgagactccatctcaaaaaaaaaaaaaattatgcagtttttgtcttagagtatttgtaaaccaaaaatagcatcctaagcacccccacccttaaccatctgaatggacgtcctcctcagccagagctcttttaaaattaagctgggagactgttttaggccatgacaggacttgtgggtcagacatgcctcattatacctctctggcatcaatatcaacacagacttaaatctcataagaaacatgttacaacctagtctctctgaagtctagtacctgaaggtttcctctgcaaataagaacttgggtcaccacaatcctttatctcaacccaggcattcctttctgttgatcctaggcatttttgtttgtttgtttgtttgtttgtttttgctttgagacagagtctagatctgttgcccaggctggagtataatggtgcattctctgccaactgtaacctctgccacccggattcaagcaattctcctgtctcagtctacccagtagttggggttacaggcacccgccatcacatccagctaatttttttgtatttttagtagagacggggtttcaccatgttggccaggctggtctccatctcctcacctcaggtgattcatctgcctcagcctcccaaagtgctgggattataggcacgagccaccaggcctggccgatcctaggtttttagaaaacccaaccaattgtcaactagaaaattttttaatctacctgtaagctggaagcccctgcttcgagttgtcctgcctttctggaccaaaccaatgtatttcttaaatgtatttgattgagtctccataaaatctgtaaaaccaagctgcaccccaacctccttgggcaactcaggacctcctgaggctgtgtcatgggccatggtcgctcctatttggctcagaataagtctcttcaagtgttttccagagtttgactcttttcatcagcaggcttcaggaacagagcagtttctgtttttagtaattttatgggaaaaagttggatctagtctagtctgtatgtagataacaagaactcggccaggcgca

SEQ ID NO: 1641 - DNA, 1100 bp, artificial
  synthetic oligo
tagagttcaagaatgtattcactttcagttataacctaaattcaatatctgtgtcttgttcatgttccgtgttgacctttttccattttctccgagtgtgtaaactactggatactctattcataactatttcccccaaaaaaatcttttgaatttgttacttttggattcgttttccttttactagtgattcgtatctgtcttttattcatttcctctttcctttccccttaggtttattctattgctcttttttttttattttttattcttctcctttatcatgtaatgtgttatctattttaataagatgtgcatttaggactataatcttcctaagcatacagttgaggcttcttcaataggctcctggaaatagactgaaaactgtctttcttttttttttttttttttttttttttttttttttttttttgagacggagtctcgctctgtagcccaggctggagtgagtgcagtggcgcgatctcggctcactgcaagctccgcctcccgggttcacgccattctcctgcctcagcctcccgagtagctgggactacaggcgcccgccaccacaccttgctaattttttgtgttttgtttagtagagacggggtttcactgtgttaggcaggatggtctcaatctcttgacctcgtgatctgcccgcctcggcctcccaaagaaaactgtctttgtatgtaaatggtctaatggaatggttcagcagtgtagagtccaaacttttaggtaatttcttccctaaatatggagtgctcccttgaaattcagaagctcttctattaacagtcagcaatttggaaaatatgtgtaaaagatacttatgtcgactactcacgaattaggacgttatagtctttgaactgtaagtcgtatcatccgatgtctcaaggcagaaacctgtaatatgtaacctctgatatggttagaggtgattctatcatatgtgtcttcaatctaatcacacacagtagctcatgaagactgacagaagggcagggagcatgcttagcacaggcatcttacacccactttgagcgtcactgacctacatgcatgctccctactacatcggc

SEQ ID NO: 1642 - DNA, 1100 bp, artificial
  synthetic oligo
gaaaaaatacagaaggataccaatcaaagagtggctgtcatttattgagctcttttctggagttgctattctgcttcactgaactgtgtttcgtcctgagccaatactgaagtactttacagtacacacacattcgaatagtaagtatcttaagcaaaaccactgaccttttcttattacaacatggataacacaaaccttgggacaaaatatgaattctgtctccatgagtacaaaggttcttggtaaacctccatttcagagcctcagtttgcttatttataaaatggggctaccatccttacgcaaatgggctttattcagggtgttataaggtaggatgacttggcactccacatgctgttaaagggtgcttacagcactgttgacacaatggcttagaagattatacaacaacattctaagaagaacaaattaaactaatggcacactgcatatttatgcataaaattaaactgcttcatctgatttagcaaggactgtattttcaagtacacaaaatatatttctttttttttatgtttccaaaatttattaattaaatttaggtttattttagtaataaagtgtaaatagcaaatggcattccttttcattattgggttagtagatactacgttcagtatctttttcttacacacatctaatgaaagatgtgaaaacaaaaactttcacagtgaagagtatactcatgcaccattaattcatcatgtcccatagcttaaaaaattcccaagaagtgtatccatctcttttttactggcgctacaatttcttcacttttgccatcctcatggaactgtcagccagcacactggaaggattctctgaaaacaaaggcatcatcaagttctctgggttttggtagagattgaaggccaacagacctcagactcatttagaaatatttagttgaggaataacccttcataagcagtcgcttgacaggcgacattttatttttttttttaatttatttttttattgataattcttgggtgtttctcacagagggggatttggcagggtcatgggacaatagtggagggaaggtcagcagataaacaagtgaacaaagg

SEQ ID NO: 1643 - DNA, 1150 bp, artificial
  synthetic oligo
ggagaaggacgatcaccttgagacccttcggcctctgaggccacgggccatgctttcccacgctccggacagccactggctcctcctcacacgcactcacacttcaacccttgggaggactggcctgcggacctaccagctgcgtctcagtgggacagaaaaagtccagacagcaggaacgcgaccctcacaccctcacaactccagggcattcaccacgtgggaaaaggggccgaggggaagacacccagtggacatgcgcagtgaggtcggtgcctgcctagtgggctgtggcgcctctcctagccccaccccatgccgcgccgcgcagttctctaccctctcccaggttcccactgaagacttcggaatgtgtcttctgtgggcggtttcatatgcctccgggactcaaataccacaaatagtttcccccttcaaaactcactccatgttcactaggtcctcctcccctctatggccctccttcctcccctgtctgggacccccacgacagcaaggccatggctgtgtcaccacctgttaggagaaggacaggaacctcaaggacctccccgtcggaggccatagaccgcgccgcgggctcctcctcacagtctctcccacttcaactctgggaagactgatcttcggacttactggctgactcctagtcagcaacacagaaggaagtcataatgtctccttgcacagctctgcagggacagaaggcggacagcaaggcacatggacaagggacttgggcagcaagggacgtgcacactgagtcaggcacatgcaaggccacccggggttttccctctctccccaggctcgcatccctaaggtgtttgtagtagaaggaaagggactaagaggcttcgttctctctcttgccctaccattctcatgcatccagaaacactggggacagtcccatgtcaccatgagtggaggatgtgtctcagaccttttgtgacagaaataaattattttattatatatattcatacatacttctttctcatttatatatgcatgggtgtctgccatgttgcaggaaatatctgggatgctggaaatgtgaagaccaaggaaccacacgtggtatgtcccatggaggctaccacactgtggtggggcagacagacag

SEQ ID NO: 1644 - DNA, 1400 bp, artificial
  synthetic oligo
tcagatgcagtcacagcaagagatcacccaggctcatgaggcagacatggagacacagggagacagagacagacagagtcaaagggagcaatgaggtgggggagggattgaggattagggagagcatttctggacaccttctgtcctcacggagttagcctcgatctcaggacccgggcccaggcagccgaataaccttttgttttccaggcgaagggagaccccggtttctgccctcagaggctgtttctgggcctaggccacatccaggagggcaggagctggcccaggcacacaggggagccctttacccatcaaaatggggatccattctaggtttggagggttcatgccatcatgaggtggaaccctgtgcccctaaggccccagctgccctcctgctgaggtgctgctgtcctggtgtggggaaggggtgtctctgccccggtggaataagagcatgaacctgtgctgcttacgaaagtgctggaagcttcccccaaccttgggactgcttgtccacaccctcttcatccgccctgagcaagtctgcttcagcctcctgggcaagtgcactcaggaggcacggcggccacctggcttctctctgccctctgtggccctgaacagaagggcacctgcagatctttcgcaagggagtgaagcagaggcagctaaagtggagcctgaagtagctggccgtgctgtgctgaggatccgtggcacagaccaagagctgacactgaggggtgctgctgtccctccccagttatcctccctgtgccatgagagacccgtccccccgaccccactccctacctctaaatgcctgattctgctttacaagagacagcacacgagggtatccatgcttcttgcagggctttgtgcaaacggaaggagcccagacatctccctgccccatctcctctagaccagccctagggcagggctatttgctcatggatgaaaacagctgtaaggctgtggaattcggggactgaggcccaggtgggcctggccggtaggcctgatcctcctggcggacacactcagtggcccatctctgattccctggtggacgtgcactcccgcaggaccacaggagcccagtgtcgcatcttcagcatttcctccagcgctctgaacacagtccgggcttaatcaatgcctggtgggatgctctctgactgaagaacccagctcttagctacgctcacccaaacacctgtccctgcttaatgcctaaaatcccatatttaggctgggcacgatggctcactcctgtaatcccagctcttcagaggctgaagtgggaggatcagttgaggccaggagttcaagaccagtctgggcaacatagcgagaccctgtctttacaaaaaaaaattaaaaatgag

SEQ ID NO: 1645 - DNA, 1350 bp, artificial
  synthetic oligo
aatgaaaaagaaaatagagtataaaattcagtagcacctatttgtctcaactacaagtacagtgagtattaaacaacaatgataatataggaacgaaaacagaacttgtagatttgcccaaattaactctgtttctccaaatttgaggtgtatggcaagttgaacgtttgttctctctgcaattgttagttacattatcagcttaacactttcaaacactgcgggaggcatttctctgttcacacagacttaagcacatatatactgagctataaatagtttgccttccacgtttggattgaacaaaggggggcgaacgcaggaataaaagacaagaggcaaaagagtatatttggaagaaggggtcagggggaaccttgcctctagtggacaagggccctggtttacacagccctccatatttattaggcaaaagagatagcgaaaaagcggggttgggggcggtgattgtcgggtaattgtcagtcagctgtttggttcacagcaggctttgaactacatgctttgaacaataggcgctaattttctccgtagataacttcaaggagccatcagggaatgatgtccctcagcaaacgttttggtggcaggacaatgtgagtttgcccacatcctgcattcatgataaacagtttgctgtttgatcatatagcctccagcgaaatgctgagctggtcacgtcccacgggccttcggctccctgcatatccccctttttgttttatgtattaattgaaagaatgtaagtccaggctgggcagctcttactatccaattggtggtccatcgaattttacagaaaatgtagcattagagctgtgtcgtgactcctatcggccctctctccatctttgcactcaggctcagctggctcatggctcgtaccggagggaccgggctcatggttggccaccataggttcctccagtctcccgttccatggtcgcacgcacagtttgtccatctcctgtaaacacacaagcataccatcttccccatatcagtaagtccaccacacctttccattgtccttcttttggggatttccataacactttcggataaactttcctcttttcctctaacgcttgccagtgtctttttgctggagtcttaaccattcataccaggagtcaaaaaatttacagtaaataaggctaaatgtagttttgattgaggtggtagttggcctcgtatacccccttttgtcttttcaacatgtgttgtaatgtttgatgtgcctgctctataatgccttgtcctctaggattataaggaattcctgttttatgggttatagcccaaagctgtaagaaattttgaaaagca

SEQ ID NO: 1646 - DNA, 5400 bp, artificial
  synthetic oligo
cctaaacccctttattaatccagtaggaaatgcaaagcaaggaaacgcaacaagcaacctgggggggttcacaaaaagagggaaggaccaagaggtaggcctgcacggatagcagaaacatggagctcaggagcaaacaggcaaccagtcagccaagagattcagaccaatgtctgcagggtggagagccagagtcatggaatcccataactggggacgacccaggtcatttcactgggctttctacctgattcaggaatcatgcttcctccagttctcccagactcccacccgagctccgctgagagctccaggtccatccagctcccacctccacctctcgaggcagtccactgcaccaccagaatgccaggttggaaagttcttcctaatctatctcaaatgttcccactgtttcgggttctgctcactgaagccacacataatgagtccgctccctctgtcacaggcctgacccctctagaaaagtcttctgcagccaggctcgaccataccccatgcagtcttcctctgcccccggcccaccatgaccctccctgaatggaccttggtctacctctgtccctcttccagtgtggcgccccaaggcacacagtcggtcctcccggactgagctcgcagcagccctgcctgggcaggaaagcccatttcctttgcccccagactcctcaggggcagtccacactaaaattcagcttagggtgtgctgcagtggagcccagccgagccctcaagctacagctgctgctcctggggcccagccatctcaacccagcaccccagcctgctgcctcaccacgggggagttgcagagagctgtctcccggcagatttcctgaggcagaaggtttccccacccccagcccagcctccaagagacactccactggttgtggcacatggtaggaccagctgagcagtgagaggagggggaagcctgtccattcgctacaggacttcagacttgctctgtagtgtggctggattaaacatagaaccatcaaatctgagctggaggggtacttcaagatcatccaaggcagaccttgccatttaaaaagatacgggggaactgatggcctaagagagaaagagactcagtcaaggtcacaaagccaatctgcagcagagctggaaggggaactcaggtctcccaactcccagctcagtgttccttcgaatacggcagaaaagaaataagggagcctttagggcagccttgggagtctgcacgcccttgactctctcagcctgatacatgtaacccaatcagctcaccatggtatctacacagaaaaagtggacccagcccatgtcccaccaacccaagagatagtgccaaggtgtcccaaatagacacacagaccccagtgcaggaactggaaccgatccagcagaggggcaatctagacttcccttcccggtagggctctttaaatgggtgttgtttttcttgaagggtggagagggggtggactttgaggaactagccaagggcttggcctccatctttgctcccccatctttgctccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcgggaccgccccggccgccggcccgccccccgcccctgcccccacccggctcgcccggcccgcccccgcgcgccccacctgcggctgccacccgcacccgcagctggactggccccaaggcaccggcgcccggccagggccagccccatgacagcccgcaagagatctctccattccacccgtccctgggtcctcacttaacggagcctaaagaagccctccttcccagagtccgcccgtccctcgggttcgccaggttggggatcttcatccaaagccatcccgggaggaacccccatcccaggcagtccccaggtcccgacaacccgtggactccccatgccctaggtctgccaatcccaagcagtgtcagattccccttcctagccagcccctgtgtcttctacctcaggcgacctccctccagcccccatcatgggcagtcgtccctgagtctcccatcctggccagtcccttgactgtctgcagctgccctcatcccaggcatcccttgggactcccaaaggatgcgcacacacacactcatgtacaacatcgcaggcatctcccactccagccagcccttacactctccattcaaaccagtgcccagatctcctaccccagccaaccccagaatcccccatctcagccagtccccgggtcctctaaccaaggcagtccaggatctctcaactcaacaagccctgggactccacatcacagccagtcttgggatcaaggctccattcattcaaccaaccctcatttcctgctctcttttagaaatgctctccccattcactccatcatccccatccactgaaactgtacccatccttcaagacttaactcaaatgccaccttactgaagccaaccctgatttcctcagccagaagtgcaagttgctgctctctctctctctctctctcccctcttgacctcctgctgcactccctatcttgtggaatttgtggaacaagtggaacttgctttacagcacattcgtctgtgttcttgttttatgtcctctgccagacggagctccttaaagacagaaacgtgtcttaatttatctttgtgagcaggttgggttagaggagaaaacatgagttttacagtcagacaaaactggatttaaattccatcttctctcttaatttcaatttccctatcaataacagctacctgacagggtggtcttggataaaagcatgcaaaaaacaccttgcacagaaaagacaacccacagaatgagagaaagtatttgcaaatcatgtatctgataagggacttgtacgtagaatatataaagaactcttacagcaacaaaaagacaactatttttttttaatgggcaaggaatttgaataaacatttctccaaagaagatatacaaatggtcaataagcacatgaaaagatgctcaacatcattaaccatcagggaaatgcaaatcaaaaccacaatgagctctcagtgctacccatcaggcgtttcctgcattctcccataacctaaagggaaacttccacaatgtctggagcccttaatgtcctgcagatgaaggaagagatatcctcaaattccttgcagcagaaccccacttgaatggcaccaaccttgacttccaaatggaacagtacattacagaaggaaaagtggtggcatctacatcataaatctgaaaaggacctggaagaagattctgccattgttgccattgaaaaccagactgatgctagtattatatcttccaggaatactggccagtgggctgtgctaaagtttgctgtttccactggggccactcttattgctgggcacttcactcctggaactttcactaatcagatccaggcagccttccaggagccacgtctgctggtggttactgatcccagggctgaccactaacctctcacagaggcatcttatattaacttgcctatcattgctctgggtcacacagagtctcccctgcactgtgtggacactgccatcccatgcaacaacccaggagttccctcagggggtctagtgtaatggatgctggcccaggaggttctgcacgtgcgttgtaccacctcccgtgaacacccatgggagttatgcctgatctctatttctgcagagatcctgaaaagattgaaaacgaagagcaggctgctggagaaaaggctgtgaccaaggaggaacttcagggtgaatggactgcgccagctcctgagtctactgctattcaacctgagggtacagactggtctgaaggcatgcaggtgcccttt

SEQ ID NO: 1647 - DNA, 1300 bp, artificial
  synthetic oligo
atctccagataagaacactgaggaccagagagaagtgatttgcacacaattgctatgatcagtcaccactaggatatgacccttttctcaggctatttcctgcggtctggtgttccagagtcttaagattgcagactttagagggcagaaaggtaggaaagtaaccatctgtgaggaacatagaagaaaaaagaaaaggaaaaggaagattctcttctctgtggggatccctaaagagatagcggtgcttaaaactgagacggcatttggctaattaattaattatccttccagccccctttcccctagtgggggaaggggtgagatgtaaccaaaatacctatcagtctcaaacagctgcacagaaagcaattctaataggcaagtctggggtttcgttttaggaaaattttctctctgaagatgatttgtaagcttgatcctgtcagaacataaaaccacataacccaatgtgtttccaattttgtcctagctgccataaaactttgagccaaattcagagtccaattataatccagttcattttaggtacctggcaacatctattcgtgcttcctttacatggtatctggtctgttttcttccacatttttatccctaattgtctttctttcatgttataaactgatgagtcgcctaatatcctctttaaagtaggcgggatataaatcttacataaactaaattatatttacagatgctaaggggatttgaaacaatgaagaacatttgaaggaacagatgatatttggcctagaggagagcaggcttatgaggacatgattactgtcttcaaatatccaataggctgtcaggggggcaatgtagtggaattattctgcttagctccaaagggcacagccagaagcaatgggtgaaaattacagagagatgatcccagagggaagaaagctctcacaggcgatgcttggcgaagatggcgagttcactgtcattggaggtcttcaagtagtggctggacagcctcatcaggagggtctgttgcctagggaatggaaacactacatggaggagttgaataagataattttggccaggcacagtggctcacgcctgtaatcccagcactttgggaagccaaggtgggaggatcacttaagctcaggagttcgacaccagcgtgggcaatgtagtgagaccctgtctctactgaaaaaaaaaaaaaattagctggatgtggtggcacacatctgtggtctcagctacttaggagactgaggcaggaggattgcttgagaccgggaggttgaggctgcag

SEQ ID NO: 1648 - DNA, 2100 bp, artificial
  synthetic oligo
accaccctggccaacatggtgaaaccctgtctctactaaaatacaaaaaattagccaggcgtgttggcgtgcgcctgtaatcccagctacttgggaggctgaggcaggggaatcgcttgaacccgggaggcggaggttgcagtgagccgagatcgtgccactgcactccagcctggcaacagagcaagattctgtctcaaaaaagaaaagaaaaaaaaaagagagagagatctgattggtcctggaatgagggatcagttctgcacctttccggtgggataagacctactcccaggcataagagagtattgccctctagtggtaataataatgataatgatgataatgataatgataatgataatgataatgataataacaactagtggatgtggtccttgcttgggagatcaaccatacccgtttgcccaagattgttttagcacttgaaagacccacatctcaagaaacctctgagtctcaggcaagcctactccttgatggtgttcaatgcactcgtatacacatgatctcattacatggctcctaaccctcgatgccaggaatcaggattcagtctgcacagatctgtagagctttagagatccagcccattttccagatgaggaaacaaagcccaagaggagggaaaaaatttccttcgtcagcattacattacaaattaatggcagaaccagaatcagcatctaggtgtccaggtccacagccccggccactgttgcccctggctggcatgccctcagctactctgtcagtttgtctaggtcccatgtcctccagactcgctaaactactcaccccttaatcctttcagaaaacttccccctctgaaagcctgaaacactcatttgacacttagcatgtgctataggtaccgttttttatcccttaaatgtatagttcaaaaaaaagaaagctcctcagctccccacaagcccaacccccagagatactaacaaggagagcggcctctggtcagaagagtctcaggagtggccctagttggtccagggccccgaggaaagtgcatttggcactgcagagcaagaaaggaagcagagggaggcttttgcaatcaccaggtgggatggatttgagagccaagagctgaggagaggtgaaaaggcatccttgcagcctcaagacaaaaggagaaagtgagagccttctttgccccagggatgccgccagggaatgggtcctgctttttctgctgccaaaattgctgtgcccttctccgttcccctggtccctgacaaggacccccaaaatcagctcttgcctttcccctccactgagacaaatttgcaaactcccacatctctgtggaaacggcagagagcaggagagaagaaaaaaggagaaaaaaatccacccacatgccaacaaactggaaaaaaaataacccaggccttgtcgcactcagctgttggcttgctgctccctcccactgtggcggctgctcctgcctcctggacatggacccaatgctgtgcagttccccttcccatctggagctggcttttgtcaatgccccttgtccctacccccaccccagctctgggagagagagtcctggagtccaggaggaggaaagctggaagggaggaccggcagagccacccagggctgtggctgaccacagactctgtgcccatcaccgtctcccaaactatggaggggaacttcctcccctcccagggaaataagttaaggagatggggcactgcccacaggctggccccaccaggccacttctgtctcagaggctgtcccctgcgtcttctgtcctccctcccccaagcccttccccttggctgcctctctctaccattttcaagctctgttttcagtctaactccttctattttcatctttttgtgccctcgcctttcttcaccttctgctccagttctgggcaccatatttaaacaaagcaaaacaaaacaaaatggagtgtgttgctaggaaaggagggatgtagaaatcatcactattaggaaaacggagatgttttgcccgtagaaaggaggatatggactcagaggagcatggaaggatagaaacacaaggagcttt

SEQ ID NO: 1649 - DNA, 1400 bp, artificial
  synthetic oligo
acactgagtgacaggctgactctccactgtggtgacttgagtcagttttttggctactagatctataactttttctatcatatagactgaacaatattctagtagggtatccatctgtttcatgcccagggaaatggtggtcaatgtgcctgaacatccacggtgctgtatttggcagttaaatgctgccacttgacctctgttactttggtactccatgaaccccactgaaaccagggagcccatcccttacagtcataccttgcctacaaagaagagcagccatagagctttccaaggatgcaggtgtttttctcagtaatggatttctcaatgccttggtgaagggagtgtctttcaaccattttcatggaacatagttaggagttgtgggcaagtcgaacataataaatctccaacattcctatccccttaagcctttggattccctttcccatatcacaccagggcagctcaggcttctcaacttaattaactgtagggccataattgagtccaagcttcaggcaatcaaccaaataagctcttaaagctacctccagctgcataagctgacactttaaatacagagtctctaataagtgtacttatctcaatgaattctgccctatctagtattatattttgctctcctttgtctaataaccttggaaaccacttctgcatatattccctatatttctgtcaatgtatattagcaatcttacaatgcttttggtgtataagctgcttcctccttgttcatagtgtgcacttgttcccctggaccatgctgagatttaaccttaattattggtcttgtggcaatagggggtggtcgtggcaggaagaggggagaatgggcattccctttcaaggcatcctccccaggtcagtttatctcagtgttttcaaggagagaaagactagtctcagacactgaaacactgaaggacaagctatttctattagtacgggagactcagagtgacttggtagttcaagattgtcagtttcatctgagaccaaacagatgcccctccagatccaagtttcaggatcccattctttatctttcacatgagagacttgtcaagactgtgagttcaacttgcactgcacaattaaatgttgtgtttgattgtcagtagtatcagcccattaggcatcatgaaagttctctggttctcagactgtgacttgagctgagaagtcaatggaccccaccttgttcttttcttttcttttcttttcttttcttttttttttgagacggagtctcactctatcgctcaggctggagtgcagtggtgcgatcttggctcactgcaacatctgccacccgaattcaagcaattctgcctcagcctcccgagtagctgggattacaagtggctgcc

SEQ ID NO: 1650 - DNA, 1350 bp, artificial
  synthetic oligo
ttttagagaaatgaaaaagcaaaacagtcagacagaaattatgatgcatttctgtaaagttacagaatgtacttgcctctcctgcctccccttccacctcctccaactcttcagcctttgtcacgcatgagacaacaagaccaacccccctcttcttcctcctcctcagtctactcattgtgaagataacaaggatgaagacctttatgatgatccacttcctctgaatgaatagtaaatatgttttctcttccttaagattttcttaatgacattttctatcctgtagcttattttattgtaagaatacagtatataatacatataacatacaaactatgtgttaatcaactgtttatgttatcagtaaggtttctaatcaacagtagttaagtttttggggagtcaaaagttatatgtggatttttgagtgtgtggaggtcagtactctaacccctacattgtccgagggtgaactgtaatttgcaattttctaaagttacctcctatttattgcaacaagtccatttcaatgtggctggatgtggtggctcatgcctgtaatcccagcattttgggaggccgaggcagcccgatcacctgaggtcgggagttcgagaccagcctggccaacatggtgaaaccccgtctctactaaaaatacaaaaattagccagacctggtggctggcacctgtaatcccaggtactcgggaggctgaggcagaattgcaatgtacccaggaagtggaggttgcagtgagccgagatcgcgttgttgcactccagcctgggtgacaagagtgaaactctgtctcaaaaaaagaaaaaaaggaaatgttttctcagaattgtcccctctcttaaatttttgagtcttttcatgagctcacgatttgtctctgactgctcattctgaagaggggacttaatgtttgtctattactggcattagagacaggttctctctgagatggtatttcagacaaaggagaaaagagaaagttcatattttctgtagttttatttttctatgttgggggattcaactgtgacatgaggaatatgacatgagctaccaaaatgtagttatatgccagggattttaactgttttttgaaatgatgagctttctcccctcaagtagtctgtgggccagtgcaatgttgtgtagttcccaatgtttctcatgacttgaattttctccttagagtgagatttccttccatttttgcctcaggctcctgctgtctgaggtttggagttcctgtgtcagatcataagtgtaattgcccatggaaaatagggagctcatggtacaagaaccttcctgatgtgccaatgtttatta

SEQ ID NO: 1651 - DNA, 1100 bp, artificial
  synthetic oligo
caagtatctacactccagcaaaatatcagagagttcaccaaagaaatcaaacagtcccagagcaatggtctccacattctgtaattagaggtcctctggcagattgtacaagtctccatccagtcaccttaaaggaaagcccaatagtagacttgacaagccccttccccttacacagagctccgagtcagcattttattgtgttcttaaatcaatgggctgataagcttgcacatttatgaaaaaatatgctaataggtttataaatgaactgatgaagcaaatgtgaaaaacaaaggctaggcacattcaagtggaaaaaaaatcaagcaattattaaaaccagaaacatttttaaaaattttaaggtaattgtagtacatgtcttgactttgtagtgactactgatttactaggaattgggaaataaacctatgaaaagagtaaatggagggaaaataggggatggaaaagagataaatcctcttctaccataaggagatgtcaaaagataatgtctctaattgctaagttagaaaaatactaatataagtatattatgaagaatattatgaagaatcatggtggtccgtcacttaaaactcctttcagccataagtaaaaacaaacaaacaaacaaacaaacaaacaaaacacccaactgacagtgtcttaaacacatatggctttatttatttttcagttaacaggaagtgcggcatgggttcaactgctcaatgatgttatcaagaaatcaggttctttctgactttcttccttaacatgttgtcttcatcctcatgctaatccctacatagtcacaagatggttgttacagctccagacagcacgactatattcaaagcagaaataaggaaggggatggcattagctatgtaagtgtctttgttcaggaagtaaaaggcccccagcaaacatctcattggctatagctggataatatagccatccttagctacaaaggaagctaagaaagcaaacagctggttgtttagcctctgaattggaggtggcaaaggagaagggatttggggatggtaaattcggaagaaacagctaaaagtattgaaagcagtttc

SEQ ID NO: 1652 - DNA, 2150 bp, artificial
  synthetic oligo
aaaataactacattttcagacatgcaaagaaccccaaatttacctttctgtaagcttagtgttccatttttggaacactaagcatgtaagaattatttatatcgtactgctcaagctcattgccaaggtctgatggcaaaaattcaaaaaaatgcaacctcagacataaatgggctaagaagttactttatcacaggtatgtatgtacaggaaaaagaagagaagttacttaaggatgttctccaacaaagtgcatgatgtatcagtcatggttcttggattcaagtaaccgaagcagactctagttaacttacgcggaaaagggattttttatgaagttatcagttagctcacagaagtctggagaatcaggctgaaaacacagagtgggagccaggaaggtaggcaggaggaaccacagctaagggcctaccatggaaacagcctggtttagaaggctactgctggtactagtacccctactgctcctaccagtgaaccttagcctaccagcacatggcactgcaaaggagcgctaattgtcctgacatctggtgttttggtttatttgttgtggacttcagagttgagttaatcataatctgcaggccgggtgcggtggctcaagcctgtaatcccaggactttgggaggccaaggtgggtggatcacgaggtcaggagatcgagaccatcctggctaacacagtgaaaccctgtctctactaaaaatacaaaaaattagctgggagtggtggcgggcgcctgtagtcccagctgctcgggaggctgaggcaggagaatggcatgaacccgggaggcgaaggttgcagtgagccgagatcgtgccactgcactccagcctgggcgacagagcaagactccgtctcaaaaaaaaaaaaaatcataatctacaattcgcggcacattatcaccagttcactgaaggctgctcttttaccttatttgttttattattcttcttccccatcagtccgtatcctcactctcattctcctgcccgacttaattacacttagcctcttagtgtaattcatatatgtatgctttcaacccacctttcatatgtttatttgtgtgtatatccatgaaaatacacagtgttgttttacattttcataaagagaattatgctataagtctctgtttcttacttttttcactcagtactgggttttggagacctatccatgtggctctatgtaaatctagcttattacttttaattgttttgtaattttctattctatgaatatacaacagtttgcttaccccatcccatggtgatgaacacctggattgcttccaattcctcactaccacaaacagtgctgcaatgaacaacctcaactacatttccttaggacttgtgtgagaatttctgtggaatatatgcccagaagcaggattgctgggttatagggtatacacatacttaatttcatggtttggtacggccaaactctctctggaatacccgtaccagtttacatcccaaatcatgtttgtccttttcctcacatcctcatcagcccttgataatatctgactttctatctgttaccattgctatagtgacttctcaccgttattttaattttcatttctcaaatcattagtagggataaaaatctcttaatatattcaaatttccccttgtgtaaactcaagtttccccttctgtaacttattcttcatatcctatgcccattttcctattgcatttactatcttctttttctatttattgttcttttgtcaggtttgcctatcacaaacatattctcctaatctatcatccttgtgttagttttgtaatatttctggcttatttgtgttgctggctccagattcaaagccgtgaaaagattagtcagtccttgttgcctcgtggtcagggaaaggaagtatctgaccaccatcagtttccatagtaggaagtgggatcccacctctcaccaagactctagagggaaattccccaaaacaggatgaaatgttgttcgggagcactagagttcattcctttggttgtctaatatccacatatactcttcctcccatacttacactttgaaaaaaatgtttccactgaatacagtgcaaatatacctcatataaaccaaacatg

SEQ ID NO: 1653 - DNA, 2750 bp, artificial
  synthetic oligo
tttatgggctttattttaaaataagcaagtaacattttgataattaaatttttggaacacattttaaaatacacatacctgtatgcttatgtaaattgaacctaagttaaatttaagctcccattcaacacactttgcattataggcttagaaagaggcaaatcaaactaccacatgagctcaattacaaataggcaccatatcacttataaatactagccaaatatctggcatcttcaactatatcaaactaaatctacccctagcagattttaaatgcatctggcatttgtcaagtacatacatgctttcccctaaaagactgggctctttgagggcaaggatcatgtttattttatttcatatccccagaaggtggtaatcattaaaagtttgatgatgaactgataatatactaatctcttaaaagatgcaccagcaactagctaaatcaggcattctctgttagctagcagctattagatcatctcactcccagagaaggaagacaaacgcaaggtatggtgggaggtgagaggagaaaaccgggtaatggcaaagaaaaatgcaaccatgcatccagaatccataacctagggaaccaggatatagtcttaatatataaactcacacaaagactattaactcattgtcagaaatgaataatgctgactttaagagtctgaaagacaaaaacacttcttatttctcctacagaaataaacatgaaccaaaacaagtcaagagtttagatgaacatgctaaaaatcatgaaaatctatgaaacactatttctaattaactgcaacagacatccttccatgttcaaatcaggctggaaaagtttaatacaaagaacaaataatcatgaataagaggaagagatcagtcctaaataaatcttttgtccatatatactgagttctctgtttcttctccaattatacaagcagtatctcaagattctagttacacaatattagacacattaagaggaacatcttgggccgggtactgtggctcatgtctgttatcctagcactttgggaggccgaggcaggcggatcacctgaggtcgggagttcgagaccaacctgaccaacatggagaaaccccgtttctactaaaaatacaaaaaattagcggggcatggtggcacatgcctgtaatcccagctacttgggaggctgaggcaggagaatcacttgaacctgggaggtggaggttgcggtgagccgagattgcaccattgcactccagcctgggcagcaagagcgacactccacctcaaaaaaaaaaaaaaaaaaaaaaggaatgtcttgggtgaaggaaagcataaacaacttttagcttttggtgacctttctctaaactataatgaatttataaaagagaacttttgcctgtcagaaaatctaggcagtgtttaatttgtttaaatgaatacagaacctctaaaatgtgtcttacctttatctgtgggaccttctgaacagttaatggggaaacctggggttgtgaaacaactgtcggtccaaggacatgtacaggtaaaacagtggactgaccttgaaccaaaggcaaaatctgcggctgagtcagctttgaatgcttctgtaactgttaaaataaggggaaaaaaagattaaagataaactttcccatttacagtaaatacactgattatatatttaaaaatataacagttcacctcacccctgaaacttgctggtaatgtcctactagttgctgagatgaataaatttgccctggaacatttacttcagcctgcgggatattagaaaccatttgagagcccatcgtttgatttgaggaataggctacactgggctgacttgaagtatctgaatgtataactgatgcagctcctgcctcagacaaattgtcacctataaaaaaagaaaataagtaacaggtagaagggaaaacttgaagcacaaaatgtccaaatggtataggtaatggtgtttctttaatggcttttttactctgagaacctgacatagcttcaaataaaatatttacactacaacattaatcaaaaaccagcatgtaaactcttatcaagcaatgaaatgttgacattgtggtataactaaaattttcttagtaaagccaacctaaaaacagagaatcagataaaaatcaactccatttgctggccatgtcatgtatatccctaactaatctacacttgacataaggatttcagtaaaatatatcatattctctttctcctataacctagaatactgtctttgtagaacaataggttattactatgcaaatactgtgtccttctggaaaagaaaatgcattacagcagaaaattagaggaattgtgttaatgttacacttgagcctaaaatacaaagggtcttaaagactagaaaattccttcttgaggaataaattttatctttagttctaaattttctttattaaacgatgtacgtggctgggcgcggtggctcatgcctacaatcccaacactttgggaggctgaggcgggtagatggcttgagcccaggagtttgagaccagcctggccaatatggtgaaaccccatctctaccaaaagaaaatacaaaaattagccaggtgtagtggcacgcacttgtagtcccagctactcagggggctgaggtgggaggatcacctgagcctggggaggtcgaggctgcagtgaatcatgatcacaccactgcactccagcctaggtgacagag

SEQ ID NO: 1654 - DNA, 1350 bp, artificial
  synthetic oligo
tgaacaaccagtaaggggcaatttcaaagtttcaaaggttaccagtttatcccaagtctttgtaggtcctgactcccatgagatggcaactagaaacttgtggccaccgtttctgtttctcagtgtcaccctattcccaccactgccacacacatcaccttcatgaaaaggcatctagctcagttgtgacctgctcctcttcccttgtctctgagcctgatgatgtaggtaatgaataaagaacaacacttggaaatgttagcccttcaatctgcttagatgttaattcttttgagcagtacctctttgatagttgaatacttgttaaaaaaaaaaaaagctattgagtagagtgacttttatgacctttagaaatttgaaaatcaaacaagtcggctccccatccaaatacaggtccttctcaatttagaccttttattgacatatgtgctcttctgtttgggacaatctggtctgtaactcagcacaaatgccactgtaggcagaaaggggagcgggcaattctagctaatcaccaaggtatgacagggaacattcccttcctacccactggtttccactgactctcaagtgacatttgcaatgttcctactcatcaaacagaaattttgatttatattaactatttgtagtttggttttacattgttccaggaaatcatccttccaataatctaattcatttttttctagaggctccggtgccaataaattacaaaaaatttaactggaatcatttttaaaccccaaaatcccacaggagtgggggtaggaggttagtttcatggccctactatctgttggtctctttcctaccacacaggatggtaactccttcagtcaacaagatggagctgaaatgaacctcaaagtttgtagttagctgaccactgcaaccatgggtagagttgtgactgtttctggaacttaatttctgacccggtgccctctttttaaccaggttattggggcggggaggtaaacaatgtccatcattcttgatgttcatttcccttaacccaagtgataccacagtttggggatcttaggtaatgtccaggcatgggtgtaagtgggagtggagtaaggatatctgcttctagttatttagatcctggcagtttgtgctgagccctctgcccacatgggtcctttccagtgctgtggtcctctccaatgtctctgcgacatggggcacagaatttttcccgaagtcccaatagatattgggccatctacctagacattccacacagctcttcctctcttgagtcttccccatcagctaggtgttgctcctgggaagctgaggctaatcaatgctgcttga

SEQ ID NO: 1655 - DNA, 1200 bp, artificial
  synthetic oligo
ccatggactctctggatctattccaatagtctgtagtagtctttcaaaacagtcttgtcacaaatccttcatgtagcaggtatgaattgtagtctccctactaaggtgtataataataatagtaataacaacaataataataatgtcggctaataatccaatagcatttactatgcgctttatacaagcccattgaatcctatgaggtaagtgccattattaacaccagtttttaaattagtaaaccaaggcacaaagaagttaaataacttgctcatagtaacacagcaagtaagtttcagagctagaatttgaacccagttagtttagtaaagagtccatgctcttaaacattttttgttgcatctgtctttattgtctatgattccatttaactttggactccaatatcccctattccttggggttggaaaataacctatattattcttgatgttcctccatctcaggttcaagccgcagtgctaagacctgggaacagaggtccattaaatccttaatcatagccaggcacagtggctcaagcctgtcatctcagcactttgagaggctgaggcaggaggattgcttgagctcaggagttcaagaccagtctgggcaatgaaaaaaaaattttagctatgtggccacacaggttagcagtcagaggtccattgcctcttcccacagtgttcctttatggtctagcaggcccttgttacactgggtccctcccagtgacttgggaatttttgttaaagttgcctagaacagcctctgttctctcacgttttgctgtctacccagggatggtgccaggaagcagaacacaggtcctttctacctggaacccaaggatctccctgatagcattatattatcctcagacctagggggtaggagggactagaatctctgtttagggtggataaaatcattctccctttatattttctggccaagacaatttgactacaccctgaccctcttccactaaggacttcggcttttgaaacacaaaaacaaagagatgggcaagtaaaatctgctcttagtctcttgccacatcccttcccctaaaacaataaaacctgggtcggggtgggggaagagggtgaggaagacagagaaattaaaagcaataggacgggcgcggtggttcatgcctgtaatcctagcagtttgggaggccgaggcggg

SEQ ID NO: 1656 - DNA, 1500 bp, artificial
  synthetic oligo
gccttctcagtttgcaggagctcattggcaatgtgaaacaccttttgctgcacagtcaactggaaaggagaaacagtaacccctgatccatcatcctctatcgtaaccctcacccaagcccccagaattcttaaaacagttcccatgccactctaagcctaataccaccctaggataaccttgacccccatctctagatctgtaagtccttcagcttcatccctgagtccccagtctaccataaagcctacccctccattctgatgacgtgcactccctcactcaacaactcattcacccgctctctctattcactcagcagagtgtagtggttaagcatgtgggatggtaagtcagacttcctgggttcaaatcctaagctctgccattcactagcttgtgtaagttctttaacagctctgtatttaggacgcctcatccataaatacagataataatagaatctatttaatgtagaggctggtgagaaacaaaaacaaaaccaaaacaaaataataataggactgaagtccattggtaatggagacaattagataatttaatataaataaaacacatcagactacagattaaatggtatataaatgttaattaatcatttattcacccactcagtacactatcagcaagggcttgctgagtacctggggtgtgagaaaagcacaaaagtataagaacgtataaaactcattgcctgttggcctagtttcctattccttagatatatgtgttgactacctgccatgccggcagtccctggctttggcccctacacttgagcttggtcctagcagagcaagtattccggctgagatctaactcaagtgcgatggtgccttctgaagaaatgttaggctgcccgggcacagaaaggggtctctgctgccaagagccttcatctgcacagcctcgggcccctgcagggctctagctcttgcgcccctcctccagctgttgagaagtctctatggatgtaagtaagagactttccgtattacaaataaggaaactgaggcttatggtagggaagcagaaagggaaaagacttgcccagtgtcacagagcttggaaacaaggtcctatttcgagaaatactgagctaggggaagaatcaagcacaaaaggcgcttccaggttctccacatggacctgcctctcggtgaacacaggtcagtacctccacagactcctgtctctccatcaggggcactgggatttctctgtccttctcttcctcctcctcctcgtcgtcctcctcctccaggtcactgtcaacctcttgggagccaggccggtgggggtcggccaaggcaacaggcacactagccagggcagggggcccagggcagaggctgtggctggggggcccgtcatcactgacgaagcaggtctcctcgctgttggatggcgagctgatgctatcaatgccgctgtcccggttgggcaccttctcaccgtcccggggcccaggagccagca

SEQ ID NO: 1657 - DNA, 1800 bp, artificial
  synthetic oligo
tgccctggcttactgactcacacaaatacgtgttatttaagaaagaagtagcagttcatttttaaaggcagtaaatgctcatattgaggatccaaagtagcagctaatcctatggcttttgattttatttttctgccctcatttctcaataagaagtacgttttacaccgtgaccataaacgcacacatacacatacatgtgtatatgcaaatacccaaaatgcatacaaatttttcacaaattgatgatacccttagtatgtgatgtactccaacattttctgtttcttttctttttttaatgctaatgataacccactaagctgattttgtgacccattaattgtcttgatccagtttgaaaaactctgaattataggctgtgagcactcgctattgttagggttaggataatctaataagcatgaggtaatggctgatgcaaggaaaagactggttaatccagaatggctgataatttttcaaaaagggaaacaaagctggcaataaagggaatggttagcaggaaagcaaataattgaagacagcaacagatgtaggtttgttgggagcgtgaggctcccagaataaataggtggagagggcaatgggcatggtggggctctcacccggatggggatgatgtggctggggcaggggatgacaggaaggcccctgtccatgagtagctggcgcatgtgcttgacattgcgctggtgggctcgcctcagggcttggccctcctctcccttgagcagccgcacagattctagagctccagagagcaccatggggggcagagaagtggtaaagatgaagcctgcagcataggagcgcaccatgtccaccaagtcacgggtgctggcaatgtagccgcccacacagccaaaggccttgcctggagacagaaaggaataagatatacacagatcccataatcagtcccagagcaacaggatcatgtgccagataacacaagggggtgcaccagaagttggggctccaggctgtcttcccaggcctctgctcatctgtccatgacaaggcagtcgtagctgataattctgctgctttgagataggactttcaagtcttgccatatgcaatgactagataggcaggagctgggtggggacctttagctggatagggtcaggagtggagctaagatgaagcttggggctagggtgggggaggggtttagaaacacagctcttcacatactcaagttgaatctaactatttggcctagttcaaggtcttttcaaaaaactctaccagactttctcatcaactctgcagtgggatgcgagtggagagagggagtccaggatggcagcagcctggggctgtgaattctgtccaaacaacccctatagctttggggaggaggcagaaaagaattttgtaagggcctcctctctggagggtatataagaaggcccaaagcattcacttaccaagagttccagagatgatgtcaatcttatgcataattccatcacgctccccaatcccagcgccccgggacccatacagtcctacagcatggacctcatccacgaaggtcagggccccatactggtgggacacatcacacaactcctcgaggggacagatggcacctgagcaaagccaagggatagaggtaggacatcataacccttccccagctccatctccaatgtggaatttcccatacatgcctactttgggttggaaaagggtgttgtagagaggaaggaggatgtgcgccttcatttagaactattacaaacctctgtgtatggatcgattgcc

SEQ ID NO: 1658 - DNA, 1750 bp, artificial
  synthetic oligo
actcctttacattcttcaaatctgctaagtataataaatacatgaggcctttcttcttttataggctggattgctactaaaacgttaagctttaatccattctccatccacagagtgggttaatgagaaatgaatggatcactgctgccaaagtgttaaccagcctgttacactgagtatcaaacacaaattaaaaatgctatccatatgcagtgatcaattggaaacccactgctcccctttaaatctattcacaacaccctacaatagtggattttatcaaatgtcaggagttcccttgcaggagataacacctgtttgattttccatattcacacacaccagttattgagcattgttaataaatactgctcattgccatatggaaatcctttcttatttttcttggagcaatggagccaaacaaagccatggagccaagcaaagccatgagcacttgattgtttgacatattatcatatgaccaaatttccaataacagtgcaactctgatgcccaatatctgctccacacaggcaaactggttatccaaggagtcattcactcactagatattcctgacaaacttgtttaaagaagtataagctaatgaaggagatcaaaaatattgaaacatgtctaatgatacctcatatgttctagaatgagattctctgattacttcaatatgagaaatgtgtttccctattgaattaaccttccattgctgccataacaatttgtcacaaactccatagctttaaattgaagaaggaattaatgaaatcaactataacctaatagtagtaatagatattttaaaatcctcttaaagttgctgcaaaatatgaccccccccgaccttacagtcaagttaaaagagaatattaacagcctgtcttctctctgtggacagtggaccttatctatactccccagctccacattcctcaaagtttattacaggcccagcgagttcctgcacggctgcagggtcgcaagaccgataagtttaggttgcaagacatgtttctctcaagatgtaagaaatgttgtaaatgctgcctttgtttcttgcttctgtaacttgcttcctgcctcacgtagttcccgccttaagatgtttaaaagtaggaaaagccctttgttcagggctcagactttctgtacatttgtccggcaggaatctcagatcccattcagagacttcaaagaggtctcacccatcccattggcacttacaaaaggtcccacaaacccagggaggaaatggtaccattttctccagacacatctgtgaaatctgtctgtgaggtcttcactcatttacagtttgtcattttaattccgcttagcacagaacaactaagagtagtacggtctgcagaaaaaaaaggaaatgaaaaaatgacataaatcttgcccctacactcaatgccctttttctggaccaaggatagactagaagcccagctgtcctggcatagtcctccatgctgatgtgtggcttacccaggcacagtgtgcatgacttttcccaggccatggctgggctgtttgggtctccatgtttcccacctccaggagagcaggagaaatggaattaggtctcaaggcctcacccagacaagactcatggaggctataaccagggctggcctcctacaagttatcctgcagagaaaagctatatcttccctgatcaaggaagcgtggaagagggtgatatggatctagaattgatgccatg

SEQ ID NO: 1659 - DNA, 1300 bp, artificial
  synthetic oligo
atgtacagaactgttgtattttcttggcccatcaggggtgttttttggtggatatgtaatcacaatcgcatcatggtgtgccctactcagctcagtgactctggtgtgggcatgtaagaatagggaataatggaaatatagcatgtgatacagaatttgtagcatatgggacttttcaaagctacttacagagacagaatcaagtttggattagtagagccattgcttattaatgtctttcagtgcttgtaaattgtcagtcactcccctaaagtcactcctcagagaacgtagactcctccagggtggattcctctgcctcttttgatcactgttgtatgcacagcagctagcacagtgcccagcacaccataggccatcacaggtaactctggattgaattaatggatctcctctcccaggagactgtgagaccctttgaagcagcctcgttgtctggggtaaataccaaggttcttggtctcatggccaaggagatcgagatcgcagacacacacacagacagggtgagtttggagaaggagtttaataggcaaaaggaaagaacagctctccatcacagagaggggtcctgagccagttgccaagttgtagtaaaaatgtcagggtttttataaatgggctagcagcgaggagggggcttgtgaagaggggatgtcttatcctcctagggcctgacagtttagttaggacgaggtgtgctatctgtacagagcagagtttttgttttgttttgttttttttttttatcagctcttatcccattccctgaccacataggctgactcttagtctgtgtttctttgtcctgcttatctgggagggagagtttctgtgtctgtttcagtacatcttcttgcagctgcaggcatcccctggagtgtgtttttagcttctctagcttagtgtgcctaaagggaaaagaatgtccttattaaggcccactgttttactggggcccattgtataagtgtgaagtttgataattacccaggagacttcccccacctccttctgtgtctgagctgtcttatctgtgttttactgtctgctctttcaggttgcttgttgttagaagagaagtgatttctttgaattgcataaggttagaaagggagctatttttgagctgctttttgttaaaaggagttttctgccagggactggctttatcatgtctacctaaataatttctttctgcctcctatgacaccttgagggcaagaactatgtttaattggtctttgcagatccagcatcagttggctggatgaaacct

SEQ ID NO: 1660 - DNA, 1450 bp, artificial
  synthetic oligo
ggtgagatgtgtcggggttcattgattatagaacaggctcctctagagggatataaagcaacgccaagtcctttgagttttaagctgttgcttgtactactctggcgaatggttttgttaatgtaactatcagggtttagggctaagcatagtggggtatctaatcccagtttgggtcttagctattgtgtcttcagggtattaaagccactttcatagtatattttatttcagctgaagttttttacaacttcgttggagtttagctttattgagggcagaccttaaacactctttataccgagctctattagctcgggttaatcctatggccgcggtggctggcatgaaattgaccaaccctaaatattagtatagtttagttaaactttcgtttattactaaagatttattactgctgtttcctgtgggggtgtggttgagcaaggtgttttgagctgcactcgtgcgtgcttgatacctgctccttttgatccgggtgatctagagggcattttcactggggcaaggatgcttacatgcgtaatcttactaagagctaataaaaaggccaggaccaagcctatctgtttatggtgtcgtgtggacccatctaggtattttcagtgtcttgctttgaatagttaagctacattaactatataaatacttaaatgtaaaattaaaatatgaaaaagaaataagtacgaatggttgtttacagttctggaaattcagggtctttaaaattgaattggcagaggtttggccgagagggttagttataattagagtataattgatttaggacataatatatggggcagtgttttcagagggatatgctcaaagtatcatgttagtattagggcagaagtatagttattgcatttattgtatgaaatggaggataaatttggtgggagggtcttagattttttagaaaaagtacatcaattgaggggtagctgttggggtgttcgtcgttaaaacacgatttctcggctccgactgggttgcattttagtctcttgtttttggggtttggcaagggtacatttacctaggttgatggtaaagtcagagatggggggaggagggatttgcagattcaatcggagatagttcttgaaatcatacatgcatgagtgtacgatttttccagtgaaaaaagagtcattattcatgttgacatcagcactgttaggtgaaaactggggacaaatgtttaccatacctgaaaaacgacataaagataaactagcttaaagcaagttttttttttttttgtacttttgcacaagagggaaaaatcaaatactggcctttctattcacttcagttatgcagttcttaatgtgacattaactgttttcttaaaagatagctttcaaacaacttccaggagcctatttgacatccagaccatagtttcaagccagaacattaa

SEQ ID NO: 1661 - DNA, 1100 bp, artificial
  synthetic oligo
agtttgtaaatactttcgaactaagtctcagggtaagtgtaagtatgtgtgccttccaaatgctcgcaaagtcacttaagttggtcaagctagctgagcaatgtctcatagctcctggcaaaagacataggatatttccgatgaggtttggtttcacaactgaactctcctccgtggaggcatttaggaaaatacagccagagaattaaaactgcagtgaccacgacttttgtcacccacccatttgctaggcccgtttcccccctaaaatcaagttttgttggaacgcagagccccacccattcaaatctccacagtggagttgagaagttgccacacagcactgggccctcctcactgtacacctctgccaggcgttctacagacctcagggccatggtcaccaacccgcagtgttcccagttcccttccttaatgcccaccccgctccttcctgggtcgccacggaggagtctggaatctgtcctctgtcgagggtttcagggactcagatacctgccccagcacccccagcactcaccccatcttcatctgacccctctcaactactcggtccaccttcttccctcgttctgaccctaccacaacaaggcccacagcggtgccacctcacgagaagaaggacgagcactttgagacccttcggcctctgaggccacgtaccaccctgccccacactcaggacggccgctggctcctcctcacactcactcacacttcaagccctgggaggactggcctgtggacctaccggctgcgtctcagcaggacagaaaaagtcccgacagcaggaacgcgatcctcaagccttcacagctccctggcgttcaccacatgggcaaaggggccgaggggaagacgcccagtggacatgcgcagtgaggtcggtgcctgcctggtgggctgtggcacccctcctcgccccaccccatcccgcaccgcgcagtcctctgccttctcccaggtttccgctgaagagtatggaatgtgtcttctgtgggcggtttcatatgcctccgggactcaaataccacaaatagtttcccccttcaaaactcactccatgttcactaggtcct

SEQ ID NO: 1662 - DNA, 1200 bp, artificial
  synthetic oligo
gcattctcagaaacttctttgagatgtgtgcatttaactcacagagctgaacctttcttttgattgagtggtttggaaacagtctttttgaaatatctgcaaatggatacttggaagtctttgaggtctatggtggaaaaggaaatattttcacgtaaaaactagacagaagcattctgagaaatgcctttgtgatatgtgcattcatctcacagagttgaagctttcttttgagagcgcagttttgaaacactctgtttgtagaatctgcaagtggatatttggagcgttttgaggtctatggtggaaaaggaaatatcttcacataaaaactagacagaagcattctgagaaactattttctgatatgtacattcatctcacacacttgaacatttcttttcattgacaagtttggaaacagtctttttgtagtatctgcaaatggatatttgctttgaagcctatggtggaaaaggaaatattttcacataaaaactagagagaagcattctgagaaacttctttgtgatgtgtgcattcatctcacaaagttgaacctttcttttgattgagcagttcggaaacagtctttctgtagtacctgtatggagtgctttgaggcctacgttggaaaaggaaatatcttcccataaaaactagatagaagcattctgagaaacttctttgtgatgtgtgcattgaactcacagagttgaaccttcttttgattgagcactttggaaacagtctttttgtattatcatcaaatggatatttggagcgcttttaggactatagtggaaaaggaaatatcttcacataaaaactatacagaagcattctgagaaacttgtttgtgagttgtgcattcatctcacagagttgaaactttcttttgattgaacacttttgaaatactctttttgtagaatctgcaaatggatatttggagcgctttgaagcctatggtggaaaaggaaatatcttcacatataaactagacagaagcattctcagaaacttctttgtgatctgtgcattcaactcacggagttgaacttttcttttgatagagcagttttgaaacagtctttttgcagtatctgcaaatggatatttgtagcgctttgaggcctatggtggaaaaagaatatcttcacataaaaactagacagaagcattctgacaaacttcttt

SEQ ID NO: 1663 - DNA, 1400 bp, artificial
  synthetic oligo
aggtctgagggcgagccagttgcactgtcctgggggcctgcgggctccgccgcctggctcagttagatgcagtactcaatgaggctgctcatcagttcggcctgcttggagtagatcttgaggagcttgttgacaggtgtgaccccgctgtccctgtcgaactccagccacaggatgggctcctcctcctcaggggaggtgtggtcccacgacagctcctggaagcacaggcccagcaggacgtgcttctctctgctgtccacgacgtgcacaccttccaggctgatggccacagaaactgatttgcgcccaccccggtgcaaaaagccttgggctggcttgtcaacctcaccgtggaagaaggcacacccatagaagggcagcttgtggcacttgaggaggtaggcgcggtagtgggtgcccagggcggcctcacacccgccgtcgctgctgacctcctgcaccttgcggtaggcgttcagcaggctctgctcacccggcccggccctggccccacggccccggagggcagcaaagagaccctggccccgcttacagaggtgggcagggaggaaggagtccagcttctccctcaggtcgcaggctgccggccagtcgggctggtaggtcacgagctgcacgcggcacaccagggcgcccagagcctcgcagtcctcaacgtcgcacaggtaccgtgcagccagcacgttgcccttggcctcctcatagagcagccgcaggacctcctcgtcggggatctggagctcccgcccctttgggaagaacacgttccttcggaactgcaggaaaggctcatccatggccacgtcgtcgtccggggcactggtgaagcgcagcagcagctccggccactggcgtcccagcttgtagggctggttcttgggtttcagctgcacctccagcagaggggagaccagccagagcgcgaagacatccagggcgatgtccggaagcttcaggacctcgcggacggcgcagtgcagctcatgggcacggagcgagggcaggttctccacagccaggggcaccaccgtgtcatctgccaggtataccagcacgtcagccgctcgggctcccacggaggacacgctgcttcggtgggaccgctcagtggggccgggctgcccgacactgccttccgtcccgtccatctcacagggtcgcagagcccgccacctgagaggcaaggctcctgcccggaatcctgcccctccaccaagcccacggaatcttgctctgtcacccaggctggagtgcagtggcgcgatttcggctcactgcaacctctgcctctctggttcaagcgattctcctgcctcagcctcctgagtagctgggattacaggcatgcgccaccacacctggctaatttttttttg

SEQ ID NO: 1664 - DNA, 2700 bp, artificial
  synthetic oligo
tgctttccttaaaaaataacttgccatggcgaattttttactgccccccacacttatctgtagcaaccagagaccaggacaaaattattattcaagctgctgaccttaatccccaattgtttaggaggtgctggggcagttccttggtcagcttggatgtcactttgccccagacaggggtgctgaatatgtctaacagtacagcagattgtcccttaagaacaatcatctgccaagtaagggtaattgctgagcaagagggtccctggcacagctacggatcacgtcttataaggtcaaaaccactaaaggaaaaggcccaaagttctggttgtatccaccactttccacttctactatctccactccccaagtgtgggaaacccatttgcctcagagatctgggctgggagtcaccctgcaatctcccttcccctggtggtgtggaaaggcttaaaggccagacacaccagctcagagaaacagctcatcgaagccttgcacttacttctcatagcgctgataagcgcgttgccgtctttgattacgtctttgatgaatttgttggtcctctccagttcctgctcataacacttgagcctctcgcggaaatcggggctgtccaggtagcagtcgctgaactccagcgggggatgacccatggttctgatggccgggagtagggggaaaggggaaagacacaaagaccgagagcatcaatggcacagtagaggaagtagaggggacggactgagcgcgcgacccgcttaaggaagctcatagcctccgtccctttggaggacaggtacctgtttcagtgagactcctgaggagcgctggctggtccggacagagaacaggcgccccggcgatggcttcagggccagggagagctaactatcgcagtcggatcccggcagggtgctgcctagcaagcagcatgtcccttaggcatcgccttcccagataagcagcaaaaaccgcagcccgacttgcctccggagacgggccggatccttcctgagcaattgcaaacgtgacacttgggcccgcccaaggtgtaggcgaggttagagctggagctgggaacagcctctctacaggctcctcgctccggagcgagcggaagacttccttggccgaactccgcgggcaacccggattgcactgtcccctcccctttcttaaagccaacgcctgcgccccgccccagcgaagcccgaggaccaaaccggagcgctctggctccttcctcaactgttttccttgtaccttagagtttcctgaccagggcccgctggctgctaagacttcttcctggtgcaagggagccggccggccggccgtccttttaggcgccggaagggttaagccagggcggcaatgaaacgtagcctcgctccatagacactgcagcgggaagaggagggcgagagcgcgacgcacaatagccgcggtagcccagcgcttccctacggaaactggggagcagtcagcgccctaggactccagctggaaagcgtggcggcctgggagatgtagtctttccgtttgcactccccaagactcctccctgcagtctccccaccaccccgcctgggaggctgctctcccagaacggcattcccagcctgccgcaggctcctgcgcagggaccggccccaaggggcaggtgcgcggcgctggactctgcgggggaagtttccgaaactagagcaagaacccgcaagactagattgcaggaagccatctctcaattcccatgattcggctgggttgtgtattcttttgccttcccctctttccagcctccttcggacctaccaacttcttttcctctttcttttcccatgtctcctgctctaagtgctctaattcccttgggccttcgacctgaagggttgattcctactctagggtctccgtgaagctcagtgccccctgccaaagaaagggaggccataattcagagttaatattttcctgaataggacctcagagcatggcttttgtggcagacgccgataatgcatatgattttccatgtgtaagtggaaagtctaagaataggatgttataaattgtcttgcagcttaccttaaaggcagctgtcttgagactaagggtaggtagaggctcgaaaaactaaaaaatagtttgtgcgtgggcaaagagatccctttaattctgcagaagtgtttacattagattgccctgtgaagaaagccagaacggaagggggttgtaaatagaataatagtggctgacccacctgaattagggtcctgttgctgctgtgacaaattaccacaaacttgatgtcctaaatcagcataaagttataatctacagttccagaaggcagaaatcagaaatgggcctcactgggatcaaatcaagatgttagaagggttgtgttcattttcagatagtctaggggtagaatctggttccttaccttttccggctcaagctgctcacatcctttggctcatagctcccttcctccgtctttaaagctagcactggccagtcaagtctttctcatgctacatcactgtgattctcatgcctccccttaaggacccttatgattacactgggtccacaggataatctcccccatcacatcatccttaatcacatctgcaaatttcattttgccacataagataacgtagccacaggtttcaggacatg

SEQ ID NO: 1665 - DNA, 1350 bp, artificial
  synthetic oligo
cccagggcccatgccggaggaggaggctggagagactggtggttagcacaccagcaggccccagccgactcacctgatgcacccccatggggcctggctcagctctgatcctgttccaggctctgctgccaatggccagaacttaccctctctgggcctccctcctctcctgccatcacctgcctctcctggtatgcagggaaaatggctgctgcctccgagctccttgcacagaccgggcagagcggatgtaggtgtctaaaggccaagcagtcctccaagtcaggctgctgctagcttatgctgaaactccagaagagacattgacttcacccagcttccacccccagcctagggaaccccctagagactcccagagaaaaggcagtgtgctgtaagagggggaagaggaacactggctttgggttggaatcctggctctgcttcacctgcatgcccttgcacaagtcatttcccactctaagcctcagtttccttatctgtaaaatgtggaagatgacattgacttcacactttggtgtgaagattaaacccccagccgcacggcagtgtgccaagcacagagaagacacagagtacatgctaattctcaatgtgctatgggctgcggacacagaaacaggaccctgttgctgcctttaggaagcttccagtctcgtatgtggagaacaatcgcaacagaagaagaattgtggtactcgtccttaaaaagagacacacaaattattggggatggtcagaaaacaaaaaagtaggaaaagtagagttagtgaaggagataatttcatttggcattcaactcaccacccaattcccgtttgtccttccctgtgttcattaagaccctggacacttgggcaagagcgtctttgtgtggcacagtcacataggaagtcacaagaccccccacagtccgctccaactcatttgggtgccttagtgcgtgtgcatatgtgtttgcatgtctgtgtacacatatgcacatgcatgtataggataaatgtgtatgtgtgtgtgcacatgttcatgagaatcttaggggagaaaaagagtgggttaagatgaggcaagagaagcaggtggcagggagaaaggctcccgtctcccctctgccagctcctctctccctcttcccagtgctgggtggcagcccctgtttacagagttcaaggagctcgactacccacccactgccccacttcaggcccctctcttccactcggcacccccttccatccctgatactcccgatttcttccaagctgtatttgtacacacagttcccagagcatttgcccctcccctgtcccattagattggtcccacagt

SEQ ID NO: 1666 - DNA, 1550 bp, artificial
  synthetic oligo
ctgggggtatggcagggagaggcagggagcaaaatggccaggagggaagggactaactttcccgtcggctgctcttggctccccccttgatcctgtgtctctccctagttaatgttccatatctccttttccagggtccttattgggctgtccccacttccccacctgtcctccacacctcagaccactgctgacagcttcccagcttcccatccctacttcagctgtcacccaggacctcaaaaacctaattacaagaatcagcggacttagctcgtggaacctctcagtcacatttgatatttgtgactacttcctgctatgtgacaattgcgactccctaatcctctactgtctactcagacatggctttcctagttctcctccggcttctttgaccattctttctcagtctctttcccaggcccctattctccagtatgccccttaaatgtcgggtcacctcccctacggatgctctccctggctctctcagcccctcctgcggcttccaccacctcctctcagcaagtaaattccatgtaacctcagcctgggctactcccccaagcatcagctagtacagacatttacccagtggtcatcatcaaagacacttcaaacccaccttgccccaaacagaatttatactcccagaccacacctcattgctccagacccacaccacacttcatttcagctttatttctccaggggtaaccctaccatccacccaagttcctggctagaaacctttgctcctccctctcccttgctcctcacatctaattagttactgtgacctgccaattttacctccttaatagctctggaatccatcccaagcattccatccctacaaacacggccggaatccaggcctttatcatttctctgccaccagagtgcgtcctcctcggaccagcctccacactacagccacttagacctttcctgcagacaaatctgagcatgtaattctccaattcaaatctgccagtgactccccactgcccccagaggagagtctaagttcctgagcctggcgcacaggcccttgagatccggcccctgctcacctatcccacctcccagccctggaagggattgtgctttcatgctatgctctatagtctcaccttactcttctgctggcaagcttctactcacacaggcagcttggtggagtggttgagagtgtgggctcagggccctgactgcctaaccaggaaagtcacttatcctctctgggcctcagtttccctatctgtaaaatgggggtgaagactgtttttaccccttaaggttgtatttctcttacaagggaataaattagatcatgcatgtaaagcacttacaacagtgcctgacacacatgaagcactgtagagtgttaaccactatttattattcccctttaagaaccagtgcggacaataccgtatctgtgaagccacaccctcctctgagactacgtgctcctcttctggctccttctgggactctagagccctggctaacttctatcacaacacttgagaccatctgcc

SEQ ID NO: 1667 - DNA, 1900 bp, artificial
  synthetic oligo
agtccaccatggcagaagagagagtggatatgggtgtggggtcaggggaggagctagattggggcccactgtgactggccttgaaagccaggctaaagaatttggacttaatcctgtcggcaatactgagccatcagaggttttgtaagtaggggagtaacatgatcagagctgtgtttaaggaagattaattaaaaataatgtatggtgtgtttaattcatggctagccctgggctttggagaagacgggagatgaagaaaacaaggccccaatgagcaggcaattcacaaaataatggccaataaacatatgaaaagatgttcaaccccactagaatgcaaagaaatgcaaattaaagcaacaatgagataccatatttggcctatcaaattagcagggattaaaaatgataacacttgatgctgcggagggttttgtgaggcggtcccttgctcactgcggggaggggtgcgggggagggggtcgggctgcaaatcacttcggccgttggaagggccgtttgacaagaaataagaaaagctttttagaagtgcacatagtgtgaccgagaaatcccacttctaggtatttgtcctaaagaaattgtggatgtgagtaaaaatttatgccccaaatatctccctgccctgggtgttatttataaaagcaaataggtggatcgaataggggaagtgttaaaattgtgtggctgcgacctcggagactggaccttaacatttctgaatcctcaaacgctggaggcagcagacaaaaccgctatttcttttttaagctgccggtggtgtgttgcccgggtctctaaggggagcagctaaaatttgtcctgggggcagacggtgcctttgttccgctagggacccacaggcgaggcctcttggtcatgcagatgtacctcaagtacctattcattgtcttggggaggccctgactccatatgcagatgcggtaagcagcgatgttaagcattctgtttaataatgtaaaaggccttcttcattgtgggctgggcggcatctctgcagaatctcttgtgatgttaaatgattttcagcttcctttggccaggctttgcgacagcatgggggcaggtggggaggggggtgggggggtcgatgacagccctggcatgggaatagaaaggacggaagaaaagaagctcgggtttgaggaggacagggtcccagcaacgaggcggcagcctggattaaagaccatgaccgccagcagtgagccctgggaaagggcagggactcagagcaaatgaggccgctatcgattgtaattccccatgccagtattaccccaagagaagttctgtacaggagaggattttaggtgggccatggaggaaaaagaaattgaatacttggggccgggtgcggtggctcacgcctgaaatcctagcactttgggagactgaggtgggtggatcacaaggtcaagagatccagaccatcctggccaacatggtgaaaccccgtctctactaaaaatacaaaaattagctggttgtggtggtgcacgcctgtattcccagctactcaagaggctgaggcaggagaatcgcttgaacctgggaggcggaggttgtagtgagccaagattgcgccactgcactccagcctagcaacagagagagactccgtctcaaaaaaaataaaataaaataaaataaaataaaataaaataaattgaatacttgcttaggatgaaactgaagcaaaaaggtgagggggggagttttgctagaaagaccaatattagtgtacatgctaggacaggtggaacatgaatatggcaagtggcgaaggtggttcgcaatgaactgctatgggaaacaccactccgtgttaccaacaagccatcagaaagtcagt

SEQ ID NO: 1668 - DNA, 1200 bp, artificial
  synthetic oligo
acttgccaatcaactgacgtctctctaatggtcgagggaagccgactaaggtgtctttgagggggcggtgatggtagggaatttagagggtggagagatttgaagaaaagttaggagagttggtgctgagcctggatcaagcaggaaggagaatatgcacacctgaaagaaagaaggccaccgacttgcatcggcacccaccctgtgccccgccattcagacccattttctctttccggcttcaccaccgcagagtgtgttccactagttccatttcacagaccaagaaactgaggctccgagaaaaatgaagtgaactgcccgaactgccccgggtcacgcagctgagcccggctgccagcacaagccagtgggactcttttcacgcctggggctctgaagagctgcttgggaaccatcaattactgaatcgaagcaattgagggagcccggcgcggcctcgccgcctgcccgggcggctgctcgagcccctcctcttctgccggctgaggcgtttagtcatttagactttgaaggcagcctattctcaccagcagctttcctgcccgcacatttgcatttggagcctttcatctgatctctcggaattaaaggctttgtctccgattaaaagaattccaggccggaggagcccggagagggaggggagggggctccaggccccaggccttccttcccagagctcctggcctcgaaccggctccgccggctccagcgcgggaggcggggcggcccggaaggcctggtttggccggataaagcgaggaccgtctcagggatcctactctactctttaaccctgccgacttccctggccaccccgggcggagcctcccagcagcctaggatgcagttggtccagtaccaggagctggctcaggcagcctcccaatcccgactctaatgtttattggctgtgtgctattgcgcagccgggctctcccctcggagcctcagtttcctcctctacaaaatgggagcaagggaatctgtaaaagttgggctccacctgcccatggcagaggaaagggtttgctattaagaggcagggaaagaaatgcaaactccagatgtgtccctatgtccctttggacaaaagctttctcctgtgtgggcctcaggctcccccttgtaaaacgggctgttgggtttggagggctctcctccaactcagaaata

SEQ ID NO: 1669 - DNA, 2000 bp, artificial
  synthetic oligo
cccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaa

SEQ ID NO: 1670 - DNA, 1950 bp, artificial
  synthetic oligo
ggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtgg

SEQ ID NO: 1671 - DNA, 1050 bp, artificial
  synthetic oligo
tgtaagtcactagcaattatacagcgtggtaggtgccatgatagagatgcataggagaaacccagacttggcggctgaagggcacagggtggaaggcggtagagagacaaggaaggttgcacagaaataacatttgatgtaggaactaagtgcacgaagggaagccggctgtgcggtgaccggagttgcaggttgccaatcttgctgaggggggctccaccggacgccggcctacgggtcgtaggcgtgtgtggggtgaagggggaagaggacgggagaggattggctgggaggaacccggagctccatctggtgggtggacggaaaccgcaggggggcgctacttgcacttcgcgctcaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcaggtatgggggaagata

SEQ ID NO: 1672 - DNA, 1350 bp, artificial
  synthetic oligo
cccagttgaaggtcagtctggttgctttgcagagggaaggggagtgtcaggtgctggaacaggtgttttgttttctcctgtagagtcatacggactaggtggggatgcttcttgccagccctctatggtgcacgaaattgcttttgtggaattttttcccctggaagtgtgtttgttttttaaagcagtttcccaaccttcaacccctagtataaattttgactcgcttcaaagtcagcttgtcatagtgaagtgtgcctgttttctagcatttccacggcctgtggccttagatataccccattttatgcggcaattataggcctggaaaatgtgtaattgtgtgtttggtaagtgtgaatattgtattttaaatgtcctaggagaatgtcacagcaaagcagccctataaaaagccttttataataattgtacagctagagttaattttcttgtatcaggttttcttaaattcggcataaacctgtattacatttccagagtgataaggctgtttccagctgttgtgatggtctcaatgggctataaggttagggatggacttatgacctcactgactggatgattttggaggtgagaggtgtcagccgacttctcggtttgggagaatttatgttttaatgtatgctactgaagccaaagaggctattggttaaaagggaaataactcaggagagctttaattctcctcatatggttgttacggttgtgaggtttgtttgtttttacctctgtactgggttccaatatcaccccccttcaccccagccaaaaagtcatcctgaaaaaattgtcttcttgcctaacaatgatataattgacctcaggtcctttccagcccctccgctctgcgtctcagggccatctgttctctgcaatccgctttttgggaaagtctcctttcccatctgctctccttgggccttagtgtcagctctaaagatttataaaggttgcactggaacctctttccagttgttatttttataaaggatcagtgacattttgaggcagataagagctttgtgcatttgacctgcccaaatgctactcccttttcaggtgcattctttccttctgttagtctggggttgaagggaagtctgtctttctgtgcttaggaggagggactttgcttatcaaagcaaagactgagtgggctggctctggctgcttttaagccaaggggccttctggctttttggctgctggcatgcaagctcagaggcgctccttgagttcattcttttcccatcttttcccttgtttccgtgacagaatacagtcgctttgaatcgaagatacatgacttacgagaacaaatgatga

SEQ ID NO: 1673 - DNA, 1900 bp, artificial
  synthetic oligo
gcaacaatatattttatacagctacggagtatccaaatagacttcctatagtttagaactataagcaccacaaagaaatcctgccagaactccaaggaacaatgagtacacactaatattaacctgtagtttcccttcctaggaactccgctatatataggagctctctcttctggtcaaacaggtctgcctaccgttccccaaacacagctcacagcttcctgtcacctgaaatgtttgtccctccatctcctttatgacccacgtccaactctgcctttctgttaaacctacccttttcttctgcgtctgaacttctggcatctcatatctgcatatggcatttaggagaaactcccttgtagttactcaggtgagtgtctctatctgtcctgttagcttagaatcttctggagtcagggaccacctctaactcagattatcagtgggaccttgtagagttcatcagctgtgatatagtggccaagtgaacaagttctggaaccagactgcctgggttcaaatccagctttgttatttaccagtagccggctaacctcaattatgtcacttaacctctgtgtgccttaattcccctgtaacatgagaatattaatagtgcctactttgtagggttattttgaagatcaaacaaagtaatacaaaacaatttgaacattgcctttaatgcattaagtacacgggaaacggtagtcctctctatccattacaacttgtactctcagcgggaagaatggtgttcagcctgtcccccacccaccatgatgtccagctcagttttgccttttaccaagtttaccaggcacaactaaaggattccctatctggctttaaatgtcctccatactctaagcctcttaactgactgacagtttcctccacagcccctcaacacagtcctgcctccttactggctcccagatatgccttgctcgttcctactctgtgccttcactcacactgttcctcctccctggaatgctaacccggtccttccccttccagctcctacctgtcttttacttctccactcaaacctcacttcctctaggaagccttccctgattacttcagtttattctcatcattcccttctctggactctctcaggaatcaaagttagtgaatacgcactgatatttttcacaacaatttattgggtcttggtcccctctcctccagaagttcggcagggcatgatagctcacacctgtaatcccagtgctttgggaggctgaggcgggcagatcacttgaggtcaggagttcgagaccagcctggccaacgtggtgaaaccccatctctactaaaaatacaaaaattagctaggcgcctgtaatcccagctactcgtgaggctgaggcagaagaatcgcttgaacccgggaggcggaggttgcagtgagccaagattgcgccactgcactctagcctgggtgacagagtgagactgagtctcaaaaaaaagaagttgataaatctcttatgaacagttgggatgttttcacctcctttgccacctgcacccagcacgtagccctatgctgggttcctagtaggtgtccaatactcatggattgatgtatccatatgcccaggtttggctaagggaagctgaggccctggctccctttctagcagtgagctcaagctggagtgaagaacagaaggcagggggccagtttctctgctaacttcccttgtttctccactgccattcaggccacagaacacagcagggtcttcaggtaagccgtcagtggtgcagaccttgaaactagactgatccctcagttaatggttgacagtctctgtttaccttaatgattgccaagattcattactgaacatgatacactttgcagttcaactgccttggc

SEQ ID NO: 1674 - DNA, 1500 bp, artificial
  synthetic oligo
atgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgaca

SEQ ID NO: 1675 - DNA, 1200 bp, artificial
  synthetic oligo
ccctcctctcattcaaatggttcccggtcccctccccctccccgtgtctctcttagcttcccactcgtgttcaccccctcggcgtccgcccccctcaatagtccctacctacgccatgcagcaggcgcctgccaagattaccctcccccatccccacctctccgggtcccgccccctgggcgactgttggggtagtgagtgacagcggaggacggggggaggcagggacccagccctcacgtgcccctccttcccttgtctgcagccacggggcccccaaaacagtctgagagtcagagttatggggtatctgaagcttgatccccagccacacaggtcgggttaaatggctctggctcagtggcaacgcctgtgcagtaaccgttactgcttgatgacccccaaaccaggtcctgcaaagctaccccctactctctcaacagtcttagggtaagttctgggatcttctccctgagtcttcctgcaggagctccctgtattatctatggagttttcctccctcaccagggctgatctctctctctctctctctctctctctctctctctctctctctctctctctctctctctctctctgtatctctctctctctttctcctccagccccctttctgtccttgtctgtctctctcttctcgctctctctctctctctccccctatctctttttgtctccttctctgcctctctgcttctcgtgcgcacgagcacgcaggcgcgctacacgctcccccctcctggatggtccttagcatgtgggtgtggctgaggttaggctagagaagtggagtaggggtaggtggcactagcgttaagcctactgcctttaaaaaattgtgccagcatccattctcagtccgcattatattaatagttagagcactttacaatccccgctccccacttcccaccacagcccctaagggctgagagcatttagtagccgaactactagaggaggctcaggctggaaggaagtctccttaggaacaggaaggtttggtatccagtgcctattctagcctgcctcgttgacttctggcctctcctcctggccacacaaagcctctcctgctcttgtagtcctcgggagtttaccctcccttttctcattccttttcccagaaaccttatccttgctagctccccacatggccttgaggttatctttgctccc

SEQ ID NO: 1676 - DNA, 5750 bp, artificial
  synthetic oligo
ccgtctctacaaaaagtattttaaaaattagctgggcacggtggcgcatgcctgtagtccaagctactcaggaggtccaagctgaggtgggaggatggcttgagcctgggaggtcaaggctgcagtgagtcgggttcgtgacactgcccaccagcctgggagacagagggagaccctgtctcaaaagagacttgacaactaaatgcaaagtatgatgtttggttggaaagagaattttgttagaaagcagctatgagggatactatgggaccatggggaaaatcggagaatgtttcatgtgatcatacagtagaaaattgtgtggtctccatgttacatttcctgagtgtcatggtggcattaaggttttgtgggagcccatgcttccttgcaggcgatacatgctgcagtatttaccgatgatggatctaaatgattccaacggatctcaaatgattccacaaaacaataaaaaaaaaaaatacacccacacgctcagaaaaagatgggggcgcggcatggagggagggctgaagcaaatgtgagaaaatggtaacaactggaggatccagtagaagaatatacgtatgggtgctccttgtgctttccctgcaactctcctgtggctccaaaatttaaacaaatgcaatctgggatgaagggcgtattatggaccattttattccagtcagtttgaaaacaacgaaaaagtcaccaattgctaggaaaccaaatccgccaagactgacacaagaaggaacagccaacctgaaccattccagaatcattacagaaagatatgagtagtcaaagtctttctactaataaactccaggattccccaccatattctgacaaacatcctaggaatacatatcttccatttgacacaaactcgtgcagaaaattgaaagggagcaacaatcctccactcactgtatgagcttggcataacctcgataccaaatcctgcaaggacacttagagaaatattgcagataaatcacaggctcatgacatagaagcaaaaatcagaaccagaatcttagcacacagaagcctacaggatataaaaggaaaacgcctaatatggtatgactaatattggcttcatcccagaaatacaaacttaatttcccttcagaaaatacagtgctataattctccacattaacagatttggggagaaagatacactttttgtagtcacgaaaagtattgactaaatgtcaatatcaattcaagatgtattgctgacaattcttttttttttttctaaaaagtcaggactattggactataactacacacagttgtatgggattttgtaaattcatactgctgtggaaacaccagcacggtatatatagatatagagcatcggcatcccccccagtttccctcacgccctctggtagtgaactcctagtcttaaccctcagaccttggcaaccaccaatctgttttctgttgctacagatttgccttttccagaatgtcatataaatggaatcacacggtatatgcatgtgcatttggcttccttcagagaaagacattctgatcacaattctctgaaggtgcaatgtacagtttcataacctcagtagtagttacctggcttgatcaccttacaactgtttgtcagagggccggcttctgagttctctctgtaagtgtgtgtgtatgcgtgggtgtgtgtgagagagagtatgtgtgtgtgtgtgtgtattatgtttcaaacatataattttacatttagctgcctctaacttttatatcttggtgagggttattaactgggaattattagccctgtaaaagaaagtgagtgattattggaaaagtcagcacagtgattacctctggggtgtgcaaagggggaggtagtgatcgggttggggcaaacaggagggttccaaaaccctgccaaccttctgttcctcgctctgcatggtagtgacctggacttcaacattgcacaaccacatgggcgccgttcacgctggatcatgagaacggagcaccctggaatcccacagatagagtttgcatggccaccctggcggccatagcctatgcggccgtacctggcaaacactggtgttggcctcatccttcaaggaaagggatgatgagaaaatgtgtgggggaaaagaggagttcttggggtggaggttaaggacagatgtgcatgaggttgtccaagttcatccaggagtgtgttccaggcaggctaaagttcatggctgttactcaccatgaccactgtgatcccatgattgccatctcacatccctgcgtatggtgccctgggcctcggccacagcctggaaggccactcttggggactctggctggcgggcgtgtgaggagactcacacacctttggccctagttggagtctgaagaggagatggtcttttctgcccacagagtaagaggtctcatctggaaatgtacctgtggcagccctggcgccgggtgtaggtgggattctgctcagggctctgccactgtggctgcatcaagggcaggcactcagctcgccagacctccggagcccgtctgagctgagtggcaggacaaggcaggagagggtctaaggctctccagcccagaccccacaatcctcttggtgggagagcaggcttgagggaaaagcaaaagggggtcactgaataaggggaggtgctcaacctcttcctctccactggggcccagatggattgcgctaatccgaggaacctcggattctgcacttatatcccctagaactggaaggctccgcctgaccatggcctggggtgtacatgttacagcctcagtattgtgtgggaggtggtctgaatatggaaccgaggtggtgtgctgagaggcggggctggcaaatccagccaccgggagatgggttcacgccttccatgactctgtccacgggtttctccccttccacactctgtcgaccacggcccatgccccccagggcagtgataggggtggagttctcaccccaccagaacctgcctagatgtctccggtggcaaaaacccaagctggagagtccctgacacacgtcttcccccagacaccagcccactgtgttatccccccaagaaacaaacacctgtgtcagggtcaaagccttggcccaaggaatcaagccaaccctctcaggcgaggggtttgatgcggatggggtaggtccccaccaccatttgtttacgtctctgaggcctgtgattggccctccatgtgcgtgatggtcccaccccatcccggcagtgagacacagtgagagtatgtgggaaggcaggtaccgagcctgactagctgtcccagggcagtccctctttctggctttccacctgcactgttcccaccctgcccatgtcaagtcacagcaccctcccatgggagatccccgcttcctagatgaaacaccaaccagcaactctgaggcattatcactgcacccacacacgggagtgctgagacatcccatccatcctgcagaggatcaggagcctactgtggtgcctccagcattctgagagcccgacacccatccctgtgtttggggatgtcccatttgtcccagtctgtgccctcctaggtgttagaattgaacaccacctcttgtcaaaggtagatctcagccctgcttttgcgcattcgatccttcacggatccttcaccactgcctccactctgtgaatcatctctttcttgctcaagggagagcaccctcaattaatttgattcccaagcaggtgcatgcaggggcatgctcatgcaggcgcgcgcacacacacacacacacacacacacacacacacacacacacactaaccttgaatggtatctgcatttctactgtctttgtctattcaacacccagtctcttggcgatgggagcagggagaacctacacacacctcctcactggaatcggaatctgtgcccgaatctggggcccacccagtcgaggattccggctgaaggtagcgggcgatcccaactgtcggggagggtgaaggcagaacagggagctcgaggaaatctcatgtgacctcgagaggcaatctggaagactgagtagggacatggaaatatcacatccacaaaaacctgcggccttgggggtggtgaaatgatatttcatggggaccatccaagaacagccaggcctagcatcgacacttgccctggaaagcagctggccattttcaaatcaagggtatggagccgaccagccgcagaaggggctgttggctgcctataggacgccaaggatgtggaagccaccttccgtgtagctcccagcccacagtttctaccaggttggcccgcaggcatcagaacagactcagtgccccggcctccaaccaagagatgaacccgcccttttcttcagcgttccttgtaccttccctttggctccgccacccaccaggaggtggcttctgcctccacctggctactaaggaggagacctgaccggatttggtaactgaggttcaaaggtgagggctaagaggaactgaggatgccatgcaggttactggcccagatgacctgaccgtgtgcatggtggcaccggagggacataacagctccagaaagaggacggggctccattgtgttcctcaacagcacagaaataatcgtgcaggaaaggccacccacatgaagccactgggagggcaaagatgcttatgatggaaagaacggtgacagggcagaactgggacagtgaaccgcaagaggaaaggtgagagagacaggggttctagaaggagtccatcagttcctgctgaaggagagggagaaaagcactgaagaaggggacctgtgacaccccaaagtgggaggagaagaggagggaccatgagcagggtgtgtaggagaaaggcaggaaatgctgctgtggccgggcagggcccccacagcacctagacccagggcactgtggtgagcccgagtgcagggctgctgctcagaggccggcccaggcgccccgcagggagagggctcaccacagagcgccaggggaactgttcttccagcgccagggaacggagcaacacccggcacaccccaacactcccaacaatcacagagatggcagaccacagaccacagaatatgagaacgactttatttcaaattgctttgaactgcgttgggaagtgtgcaaatgcagaggaagagaggaagccctggctgaacaggatatggagggaacccgcttggctgcagctccggagctccaaaggtggcagctgttcatcttgtaggaagatgctggctccaacctgtgaaacagagtaggctcagggacgggccctcagccagggccagcccacagccctcctaaggtaccatgattgtggaaaggggcatggtgtgtgcaacactcacttcaaaggtcctggaacttgtcagtgaggaactgcatggccgctgaaagagagaggcagaaatgggcactccagacccagggaaacagaaacccacgccctgccccggtggggaaccacctagccctgcaaccagaaaccccaccagccctgggactgactcatccacgcgtcacctgaattaaatgtagaaatgccttctaagcaggaaagtggttctcaggtgctggggcatcccagaacctttcagaacgtgtttcaaagacagataagccagccagcaagcaaacaccatacaagccctaccaggcttgtagggaaaacaca

SEQ ID NO: 1677 - DNA, 3150 bp, artificial
  synthetic oligo
agtattactcatttagatcttgcacatgtgaagggcattactaataaacccctattagctttgtttcttgcagcgcaagagctcctctgtgcctgtcatcaccctctttacatcacacatattcgccgtcattctgggctacctggtccttatcagaagggaatgcttgagctgatgctctggtacgaccacagatgtgctttgcaaattctcctgcttttttgcaagctcaagctgatcatgttgttttttcatcggaacgcccgccgtcttaaacaacagcttcatttgacacttactcaagcttgcatgattattaaaacttgtcctaattgccaacagcattctctttcccccttttccttagggcttagtgccaacctacgaggtctggtgcctaatgctatctggcaaactaatgtcactcggtgtccaccctttggacgttttaaatttctccatgttaccgtggacacatatacaggcctaatacatgctacctcccagacaggagaaaaaactaaagatgcaatcgctcatttgtttaaatctatgataactctaagccttccacacactataaaaactaataatggaccttcctatcttagtgctcgatttacatatgcattgcaactttggcacatgcaacataaaactgatattccttataactcaaccagtcaggccattgttaaacgagctcatcaaactcttaaagtatatcttaatttaaaaagggcgggggggaatatggggctctcttctagagaacaggaccagtcgttggagaaccaaccaacaatgatggtgatgactcggaaggcacctgacatcacctggggacagctaaagaaattgaatcaacaagcatctatccagcttgccgccgtggaagcccctgcaactgcagacaatcggtttcttacatatctggtggcaattggggaaacttctgagaaagtaagacagacatggatgttggggtggcaggtaattcttgtcctttgctaagtgggatcagcttaaggacatgtttattggagtcatgttctaaatccccctgtttttaatgttattacatggtgggatgctgacccgcctttgtcatctaatgatacttcttgggcaggaggccgatggatgcctctgtcttaccccgtaactgaaaatttgggatggattcaacttaattactcctcgattttattgtctagtaatccccctctttgtttttccacaatagcacatgataagtgtgttactctcatccctcaggagtatctttactatcagcctaaaagggatgctaagcttgcaaacttgacctttatttctactattaccactaatcttactgaggtctctaatgaagctacacaagtgcctgatcttcctatatgccgtccgagtagggactggcgataaaagtttgaggccgtccagtggtcgccgtgcagacagcctgctccacgtcaagggcctctgtttgataatggcaccttacttgattggggtccccgtggtaatcttatgtctgcaaatcagactattggacttgggagtccctccagtagtcctattacctagtcagagtatgggctttcaggaccagtattacaagtgagagggaaacaagctttaagccctgctcatacccaaatttggagattaggatttcctttttttgaacgggttctttcacatggtgagtatattactggcggtggcaaccataccctctctttgcataataatgttactgacacagtcctgatttgtaccacgcacccttatatacttttgtttgggcaaggtgttcctaacatagagcagaatcaatctttttatagtattaaagtctcttccagtagttggtatgctgcatgcttgtccatcgaaacattacacagttggatataacctatgtcatgatcttaaaatggcgtgcagaattgtggctgcctgtaaatttaacctggagctgaaaaggagattccaccctgcagctatttagaaaatcactatctcatactcggaaaaaaaaaaaaaaaaaaagattcctggccactttaattgcctttttagtctcagctattattatattagcaactgctgctactgcagctgtttctctgacagaatctattcacacagcctcagtggtgaaccacatggtgtataatgtaacccgtgaatttcaagaacaggtaaatatagataaaaccattctgtctcgcccggtctcttgaagccgctgttgaataactggggaatcagcagcaggcattcattacccatcaaaatttacattgttgattggcaatataattctatctgtgtcacgcctctgccatataatagctcccaatatgcttgggagagagtgaaagcacatctgcaaggggcttatcacgaccatttgtcttctcaaatttccattcttgagtgtgaattaaagaaacaccttgaagaatggtcgcagcaattacaaacaagtatccttcagcaattacaagaaggctttcaatggttaaacccgaacacttggttgtctgggttaaacatacgcatttgggtgatggccgctgtacttattcttttttgtatctgtttgctaggcacttgcagatggctctgtgctgccacccgacgcatctatgaccagggaagaatcatggaagcttaccttgcattggatgaccagcacgctataagaattaaagaaggggggaatatggcggggtgcacgacagcatattcaagcttatgtacaaggcgtttgaggtcggggcatggaaacatactgaggcactgtgtgtatgttatttgtgcatgagaatgaaactccttgaccctgaaaacaggacggggagtggagtgtgtggtgtgataaggaacgctgaaaacagcctcccgagaatgcggtttgagtgcttttaccaggccacaggtgtctcatgacccgacctcaaaaaggccatctagtggatgtttgtggtctaacaagccctttcaatgaatacttggcggacagatgctggggcggagtctcttagaagagctgcccccggcccccctcagctggatttgtctgagaactcattcttggcgttcactgcaagctataagctctgcgatgggccctga

SEQ ID NO: 1678 - DNA, 24100 bp, artificial
  synthetic oligo
aaatatcatatgatagttaactttatgtaatttgttatatcttggtaatggacttttcttaaaaatggacagtatccctaagaataccccgtacatttccattgcaaaaaaaaaaaaaaaaaaaaggtattccatcatgtgagtataccacaattaactgatataaactatgaaggtaaaaatttgcgttgctgccccttaacgttgttgccttaatttctttttctcaggtcctaagtcgtctgcccctgagaataagtggatggggaggtgacaaatctcccgtgagaaaaatgtaccaagtgcatggtgttccaacacataatcacaaattctgaatgaaaacttgccacccaaatataaaatatttaccaaaacatcgaaattaatatcacaattatgtaagcatcgttcctacgatgtttggtgaaatctatgagaatttgaaatcaagctatcactatcaataaactgatattagtactcgcaaggagatctgctataaatagagaaaataaaattttggttatccttctggttataaaatacttacctgtttaatgcagtgttacttcccttagcactattgttttgtctgcttatggtggcaggcaacgtacagaaagaaaacatcacagtttatgtgcatagtttaataaatgattgtccagtgcacctgcacaggaacgctcccctaggtcccagagaagaacaccgccagcattccccagagcctcctggggtgtccctgcctgagctcagccccactcctactgcaaggggaaaccaacatcctgacttttctgattgtcctttccttgctcttctctgtggttttatatcctaagtatgcattcttcaacaaggtaggttagtgttgcctgtcatttgaagttataggaatggaatcattaagcatgtccgtgttgtcccttgcttctttccctcgatgttatctttgtaagattcgcgcctattattccatggaggagtactttgtacttttccgttgctgaaatagtattccattgtattaacataccacaatgtattcattccgtcccatggaagttgtgattttcattgtttcccatatttgggactggatgattacaaaaatactactcataaacccttgtcggcaccagtaaaggagtcctgagagggacgtgtaggctgctaaaagcatatatttaaaagaggatcgcagacaattaaagagaaaacgttcgaaaaagaagcccaacgtaagaccaaggaaagtagaaggaagtcatcaaggtaaaagcagaaatcagtgaaagtggaaacaagcataaggatcacaaaaccagaagttgggtgtttggaagaagaatgaaattggtaaacctcttgtgagactggtcaagaaaacaagggagaagggcaccgctatcaggaaagaaaagggagaaataagcacaaacgatgttacgtccgttctcgtgttgctatatagaaatatccaagaccgagtcatttataaagagaagagctcatggttctgcaggctgtactggtagcatagcggcttctgcttctaggaggactcaggaaacttgcaatcatggcagaaggcaaaacaggagcaggtacttgttacatggtaggagcaggagcaagagagagagaacagggggaggtgtcacacacttttaaacaaccagactcatgacaactcactcgcgaccacagggacagtaccaagtggatgctgctaaaccattcctgagaaatccagccccatgatccagtcacctcccaccaggccccacctccagcattagaagtcacagtttgacagaagacttggtggggacacggttccaagccatatcatatgcagacatccaaaagatagaaagaagatattgtgggggaactggatattcacacagagtgcccatgcagtaacagcgcatagctaattaaatacaaagagaagatggcactttcacaatggggtaatctggaacagcgccctgagcacatggtcaagatgaacatcgccagtcatgagacaaaccgacatggagaatctgctgatgtcgtgcactgagaagaacagcatgtctgctatgcagtagtcctgccaaaaatgttatacctacctgaatctaatcacaaggaagccattcgacaaacctacgttcaagggcttcctgacaatgactgcactggtttaaagcacactttaaggcgggctgatcacgagatcaggagatggagaccatcctggttaagacggtgaaaccctgtctctactaaaaaatacaaaaaattagccgggcgtggtggcgggcgcctgtagtcccagctactcgggaggctgaggcaggagaatggcgtgaacccgggaggtggagcttgcagtgagccgagatcgtgccactgtgctccagcctgggcaacagagggagactccatctcaaaaaaaaaaaaaaaaaaaaagcacactttaaaggacactgaagagacttgatgggccgggaaccatggctcatggctcacccccgtaatcccgtcaatttgggagacctaggcgagcggttggcgcttgcctgtggtccaagctactcaggaggctgaggtgggaggatggcttgagcctggaggtcgaggctacagtgagccgggttcgtgacactacatgccagcgtgggcgacagagggagaccctgtctcaaaagagacttgacaactaaatgcaaagcatgatgtttggttggaaagagaattttgttagaaagcagctatgagggatactatgggaccatggggacaatcggagaatgtttcatgtgatcatacagtagaaaattgtgtggtctccatgttacatttcctgagtgtcatggtggcattaaggttttgtgggagcccatgcttccttgcaggcgatacatgctgcagtatttaccgatgatggatctaaatgattccaagggatctcaaatgattccacaaaacaataaaacaaaaatacaagcacgcacacacgcttagagaaagacaggggtgcaggatggagggagggctgaagcagatgtgagaaagtggtaacaactggaggatgcagttgaagaatatacgtatgggtgctccttgtgctttccctgcaactaactctcctgtgactccaaaatttaaacaaatgcaatctgggatgaagcgggtattatggaccattttattccagtcagtttgaaaacagtgaaaaaggtcaccaattgctaggaaaccaaacccgccaaaactgacacaagaaggcacagccaacctgaaccgttccagaatcattacagaaagatatcagtagtcaaaggctttccacgaatgaactccaggattcaccaccacattctgacaaacatcctaggaatacatatcttccattttacacaaactcgtgcagaaaattgaaagtgaggggccaggcatggtggctcacgcctgtaatcccagcactttgggaggccgaggcgggtcgatcacgaggtcaggagatccagaccatcctggctaacacggtgaaaccccatctctaccaaaaattaaaaaaaaaaaaaaattagccaggcgtggtggcaggcgcctgtagtcccagctgcttgggaggctgaggcaggagaatggcgtgaacctgggacgcggagcttgcagtgagccgagatcgtgccactgcactccagcctgggcgacagagcgagactccgtctcaaaaaaaaaaaaaaaaaaagaaaagaaaagaaaagaaaagaaaattgaaagggaggaacaatcctccactcactgtatgagcttggcataacctcaataccaaatcctgcaaggacacctagagaaacattgcaggtcaatcacatgctcgtgacatagaagtaaaaattggaagcagaatcttagcacacggaagcctacaggatataaaaaggaaaatacctaatatggcatgactaatattggcttcatcccagaaatacgaacttaatttctcttcagaaaatacagtggtataattccccacattaacagattcggggagacaaacatgctcttcgtagtcacaaaaggtattgactaaatgtcaatttccatttgagatgtattgctgacaattttttttttctaaaaagtcaggactattgggctataacttacacagaggtctgtgagatctcgtaaatgcgtatggctgtaaaaacaccagcacaatatatatagatatagagcatcgccatcccccgcccccctcccccgccaggttcccttacgtcctcttgtactgaactcctcgtcttaaccctcagaccctggcaaccatcaatctgttttgtgttcctagagttttgccttttccagaatgtcatataaatggaatcacacggtacgtagcatgtgcatttggcttccttcagagaaagacactcggactgcgattctctaaaggtgcaatgtacagtttcatgacctgggtagtagttacctggcttgatcaccttacaactgtttgtcagatggcgggcttctgagttctctccgtgtgtgtgtgtgtgcgtgtgtgtgtgtgtgtatcatgtttcaaacatataattttacatttaactgcctctaacttttatatgttggtgagggttattaaatgacaattattaatacttaaagggaagtgagtgattattgtaaaagccagcagagtcatttcctctggggtgtgcaaagcgggaggtagtgatcaggatggggcaaacaggagggttccaaaaccctgccaaccttctgttcctcgctctgcatggtagtgacctggacttcaacattgcacaaccacatgggcgccgttcacgctggatcacgagaacagagcaccctggaatcccacagatagatgtggccaccctggcggccacagcctacgcggccgtacctggcaaacactggtgttggcctcatccttcgaggaaacgcatgatgagaaaatgtgtggggaaaaggaggagttcttggggtggaggttgaggacagatgtgcgtgaggttgtccgagttcacccaggagtgtgttccaggcgggctaaagttcatggctggtactcaccatgaccactatgatcctatgactgccatctcacatccccgtgtgcgatgccctgggcctccgccacagcctggaaggccaccctaggggactctggctggtgggcgtgtgcagagactcacacaccttcggctctagctggagtctgaagaggagatgctcttttctgcccacagagtaagaggtctcatctggaaatgtacctgtggcagccctggcgccgggtgtaggtgggattctgctcagggctctgccactgtggctgcatcaagggcaggcactcagctcgccagacctccggagcctgtctgagctgagtggcaggacaaggcaggagggggtctaaggctctccaggcgggaccccacattcctcttggtgggagagcaggattgaaggaaaagacaaagcgggacactgaatgaggggaagggctcgacctcctcctctccactggggcccaggtggattcctctaatccgaggagtctcggattctgcacctatttcccctagaactggaaggctccacccgcccatggcctggggtgtacatgttacagcctcattattgtgcgggaggtggtctgaatatggaaccgaggtggtgtgctgagaggcggggctggcaaatgcagccaccgggagatgggttcacgccttccacgactccgtccacgggcttctccccttccacaccctgttgaccatggcccatgccccccggggcagtgcctggggctagagttctcacgccaccagaacctgcctagatgtctccggtggcaaaaacccaagctggagagtccctgacgcacgtcttcccccagacaccagcccactgtgttatccccccaagaaacaaccacctgtgtcagggtcaaagccttggcccgaggaatcaagccaaccctctcagggaaggtgttggattccgatggggtaggtccccaccagcgttcgtttccaggtctgaggcctgtgattggcccaccacgtgcgtgatggtccccctcactgagctcacaccatgggcccacagggagacgcacagggagtatgggggaaggcagacaccgggcccgaccagctgtcccagggcagtccctctttcccactttccaccctctctgtgggcatcctgcccgtccatgtcttggttagcgggtgtcgtggcaccctcccacgggagctccccacttctagatgaggcaccaaccagcgactctgaggtattaccactgcacccacacatgggagtgctgagacatcccatccatcccgcggaggatcgggagcctactgtggcacctccagcattctgagagccccgacacctgtccctgtgtttggggatgtccccttcgtcccactccacagccttctaggtgttagaattgaacaacacctcctgtgaaagggtagatcccagccccgctttagcgaattcgatccttcatggatccttcaccactgcttccactccgtgaatcagcccattctccctcaacggagagcacccccgattaatttgattcccaagcgggtgcttgcaggggcgtgcacacacacatacacacgctaaccttgaatggtatctgtatttctcctgtccttgttcgacaccctgtctctcggcgatgggagctggcagaacctacacacacctcctcactggaatcggaatctgtgcccaaatctgggacctgcccagcccaggattctggctgaaggaagcgggcgatcccaactgtcagggagggtgaaggcagaacagggagctctaggaaatctcgtgtgacctcgagaggcggtcgggaagactgaccagggacacagaaataatcacgtccacaaaaacctgttggccttgggggtggtgaaacggtatttcacgggaaccatccaagaacagccaggcctagcatccacacttgccctggaaaccagctggccattttcaaatcaatggtatggagcccaccggctgcagaaggggctgttggctgcgtataggacaccaaggatgtggaagccgccttccgcgtagctaccggcgggcggtttccaccaggttggcccgcaggcaccagaacagactcagtgcccccacctccaaccgagagactgtcttgcccttttcttccgcactccaggtatcttccctttggctcagcttcccaccaggatgtggtttctgtctccacctggctactgaagctaaggaggagatctgacagaatttggtaactaaggttcaaaggtgagggctaagaggaactgaggatgccaagcgggtttttgccccagatgacctgaccctgtgcatggtggcaccggagggacataacggctcaaggaagaggactgggcccctgaggggcggggaggatgagctccgtcttgttcctcaacagcatggaaataaccatgcaggaaaggccactggcatcaagccactggggagagcaaggatgctcacgatggaaaggatggtgagagggcagaacagaaacagtgaaccgcaggaggaaaggtgagagagacgggttctggaaggaggccatcagttcctgctgaaggggagggagaatagcgctgaagaaggggaactgtgagaccccaaagtgggaagagaagaggagggaccgtgagcaaggcgtgtaggagaaaggcaggaaatgctgctgtggccgggcagggcccccacacacctagacccagagcactgtggtgagcccgagtgcagggctgctgctcagaggccggcccaggtgccccgcagggagagggcccaccacagagcaccaggggaactgttcttcaaccgccagtgaaccgggcaacacgctgcaacccccaacactcccaacaatcgcagagagggcagaccacagaccacagaatatgagaacgactttatttcaaattgctttgaactgcgttgggaagggggcaaatgcagcggaagagaggaagccctggctgaacaggatatggagggaacccgcttggctgcagctccggagctccaaaggtggcagctgttcatcttgtaggaagatgctggctccaacctgtgaaacagagtaggctcagggacgggccctcagccagggccagcccacagccctcctaaggtaccatgattgtggaaaggggcatggtgtgtgcaacactcacttcaaaggtcctggaacttgtcagtgaggaactgcatggccgctgaaagagagaggcagaaatggacactccagacccagggaaacagaaacccacgccctgccccggtggggaaccacctagccctgcaaccagaaaccccaccagccctgggactgactcacccacccgtcacctgaattaaatgtggaaatgccttctaagcgggaaagtggttctcaggtgctgggccatcccagtaccgtacagaacgtatttcaaagacagataagccagccagcaagcaaacaccatacaagtcataccaggcagtagttaaaggggaaacacaggtggtatctctaaccgccctaagagaaggagagttctgggactcgtggactaagtgtacacggagttcagacgacacattgctgtctgtgcacacccctagctggaaaggcacagaaggctccagggccaggtctgcttgattctcctccccagaggaaagtcagtcccagtgatgctgcccatacctgcagcccaccaccgcccccaacaccagcagaaagacaccgctgtccatccctgccccagccagggctccctcatacctagctgctgtgtaaggtcctcaatttccctctgcagccagatgcactagaccagcggacaccggaggaagataaatggttggtcaattctgtgctcctctctccccagcctccctgcagcccccatagcctgcagcccagtggcgaggtgggttggcagggaaccctcaatggaaacgaggcaccctctctccgtggggtgcagaaggtggagatgtgcggagtgcggtggggagggagggggcggacgcagaaatcagtttaacctggacacggatcccaccatctactgtggacctctatttctaggagccacacaaagcattacccgaggacagccctgggctcccgggggctgctgctgcctttccggtcttgggggatggacaggcggctgctggttacctgaaagagaacacaaaatccagcttccaagcctcccagtgaggtggaaagggcctagtggtgtctaatgtgaggcagcatcaccctctgctggtacacgttgcccctgctctgcccagcaactccaaccccgctctgggactgccttcactgttccccagtgtaagctcatgtgcacctgtggccccctagcattgtgactccaggttggactccagcagtgcggcagccacagccaggccctgggagggcccatgtggctgagcaggacttaacagaaaagggctcagtactgccgaaagtctccttccagagttgggagtttggggcgctgctccaaatcgccccccaccacacaaaccccactcagagaggacgatgtggcttaaagccagcccagtcaacaccccgtttccccgtgggacagctgcctgggtgggcagggaagtctgggaataaggctgagcccccagaagcgacagggccagaggtttccctcccgacccctctcccctccacccctatcaaacccacaagactcaccggagggtgcatggcgtctgggcacgaggcctcccgggctgtaggccgagggctctgaagttcccggaagttggggagctctgatgttggggtcgctactgctgaattctccacgacgcacagacaggcgaggcagtcctggcctgtgggtgggaagctaaaacagaaacttctgagtcgggctggcgatgggggccggcggtgagtacacgtggggaggggttgtggtaaggtggagactcctgagcctaatctcattagcactttctccctcagtcagcctcaggccaggaggcagaggccagccagggaaaacactggggatactgagatagcccggggccgcctgccaggtgggttgggcaacagctagggaaggaggaatcaggaagttgatgagcctagatgccccagctttgcagcccacactttaaggcatcacccgatccaaaccagctgccagccctgccttccaccccagctcctctctgcgggcggaggcaggacccctgcagagcgtccagaggcatggccatcacacaagaagtgctccctttaacgtgtgcccttatgaggaagacacccatcgggcattctagtgtccctgggctcccgatgacaaccctcgagcaagggacagaggaggcatgggtaaacaggtgtgtgctggaagagaggaggtgtggggggaggagggtaaagagggagaggagggcgagaagggcctactcacttgggctcttgggacctcatctctatttgggtcattatcttctctggccgcagcctgggactccctggtcttcctccctgctggtttcttcccagggctgctgtgcttaggcttttggggtttcttggacatcccctgtggccgcacaccagagaatggcgggaaggtggccggctccgggggagcggctgagagtctctctccgcaggcaggaaagcctctccccagggccagttgagaggcaccccctagggacttcttccccccggccatcttcctcctcgaaaggccctggggcagggcccctgcagcagcagctcctgagcagctgggcctgacctccacctttccccaggccctgctctgcattttcttctggggagagtcctccagctctcccacagccggcctctctgcgactggagtgagtccgcggggagcagaggtcaggaaacggcccggcacaggcaggtaactctccttgcagtggaagcttgcctgtctggatgtgtctgctcgcttcttggggctgccgggcttggcctggcttccttcgttgcggcaaatgcctaccttcatcagtggtaagtcgctgctctcatctgcggaatcagagtcgtgggtaggcagcctggtggggcctttcgcagagggctgctggggatccacgcggaggctccatctgctcttcgagcccctttccgggttcttccaggcccgcactggcccaggaccgcagaggtggagacggccggcagaggcctgctgccattttccagggctgtggcccagcacgtctctcccactgggaccgacctccgcatctgcccaattctcagccgacccttcggcagcggcaccttctgggaacgggtgtccctggacgctgggcggcggcacgatggcggctggttcgtcagccaggtagaatgagtagtccacaacgtccccttggtcatccaccggggtgcctggccggccttcccggccccagagcaccacccttccttgctctatcaattcgctctcagactcgaagctgaagccctctggatctgtgaacccgctctcgctcttgccatcgccgctgcccggcacccccaaatcgaggccgtggctgtgggcccctggggctccggggctggccgtgcgggagccagcctttttgccaccctccaggtcgaaaccggccccacaaacggacaccttgtcgggggagctcatggcgccagtccgggcagcctgggctgcggggagacggtcgtcctggtaacggcgggagcggagagctgagcccagccaagcccagctgagcgggccacgcgacagaaacagtgaggccttcgggacaccaccgccctcgccccaggcggaagtaccagatgtccgggacagcgagtggcttcctcgcgcccttgacgccggcgccgagccttctcattggtccccgtctgccaaccagcacgccctttgtggggcgaggtgcctgagctttaaccaatcgggacacaggctcttggtttgcctccatgcccgtcatttgactgggtggctgcgctctggtcgggtcttggggccagggggcaccgtagctctcgatcacctctttcttcctgtccttctgcctctggccgggcacctactttccaaggagagccacgtctctgagccccagtgtcccatctgtaaggtggggattaaggggagaccttcccccagctcatcagcttgggagagtaaatgtcgtgatgcacgcaaagcacccggtgcacagaggaggtctcattggaaagtaggttcccagccagaggcagcaggagagcaagaaggaggtggatcgagagctccagtgccccctggccgcaagaccagaccagagcacagccacccagtcaaatgacgggtgtcggggcaaaccaagagcctgtgttccgattggttaaagcccagaggcctctgccaacaaagggcgcgctggttggtagagggggaccaatgagaagtcgcggcactggcgtcaagtgcacgcgcagaagccacgcgctgtcggggacatctggtacttccacccggggtgagggcagcggtgtcccgaaggcctcactgttcctgtcgcgtggcccgctccgccgggcttggcaggactcggctctccccttctgccgttaccaggacgaccgtctccccgcagcccaggctgcccagactggcgccatgagctcccccgacaaggtagccgtttgtggggccagtttcggcctggagggtggcaagcaggctggctcccgcatggccagccccggagccccacggggccagggccacggcctcgatttgggggcgccaggcagccgcgagggcgagagcaggttcacagatcccgaggtcttcagcttcgagtctgagagcgaattgatagagcagggaaaggtggtgctctggggccgggaaggccggcctggcaccccagtcgacgaccaaggggacgatgtggactactcgtcctccctggctgacgaaccagccaccatcgtgccaccggcccagcgtccaagggcgcccctccccagaaggtgccgctgccgaagggtcggctgacaactgggcggacctggaggtcggtcccagtgggagaggcgtgctgggccccagccctggagaatggcggcaggcctccgccggcccctgggagcccagggttgccctcgggtaatgctttgtgtggctcctagaaatagaagtccacgttagatggtgggatccgtgtccaggttaaactgatttctgtgtccccccgccccgccccgtcaccaccttctgcatcccacggagagagggtgcctcttttacattgagggtttcatgccaacccacctcaccactgggctgcaggctatgggggctactaagggctgggggagacagggaagacgaggagagaggaggccagaattgactaaccatttatcttcctccggtgtctgctggtctagtgcatccggctgcagagggaaattgaggaccttacacagcagctaggtatgatggagccctggctggggcagggatggacagcggtgtctttctgctggtgcggggggcgggggtgggctgtaggtacaggcggcgtcactggaactgactttcctttggggaagagaaccaaggaaagcctggccctggagccttctgtgcctttccagctaggggtgtgcacagacagcaatgtgtcgtctgaactccgtgtacacttagtccacgagtcccagaactctccttctcttaggagggttagagataccgcatgtgttttccctttaactgctgcctggtatggcttgtacggtgtttgcttgctggctggcttatctgtctttgaaacacgttctgaatgaacggttctggcatggcccagcacctgagaaccactttcccgcttagaaggcatttccacatttaattcaggtgacgggtggatgagtcagtcccagggctggtggggtttctggttgcagggctaggtggttccccacgggggcagggggtgagtttctgtttccctgggtctggagtgcccggttctgcctctctgtttcagcggccatgcagttcttcaacgacaagttccagggcctttgaagtgagtgttgcacacaccgtgccccttcccacaatcccggtagcttaggagggctgtgggctggccctggctgggagccagtccctgagcctgctctgtttcacaggttggagccagcgtccggagctgcagccaagcgagtttcctccttatcctccttagccagggctttttctcttccgctgcatttgcccccttcccaacgcagttcaaagcagtgtgaaataaagtcgttctcatattctgtggtctgtggtctgccctctctgcgattgttgggagtgttggggtgtgccgggtgttgctccgttccctggcgctggaagaacagttcccctggcgctctgtggtgggccatctccctgcggggcgcctgggcgggcctctgagcagcagccctgcactcgggctcaccatagtgccctgggtctaggtgctgtgggaggccctgcccggccacagcagcatttcctgcttttcctgtacacgccctgctcatgctccctcctcttctcctcccactttggggtctcacaggtccccttcttcagtgctattctctctccccttcagcaggaactgatggcctcctttgagcaccctggtcctttgagcaacctttcctcctgcagttcactgtccctgtttgtcctgtcactgtcctttccatcatgagcatccttgctctcccccgtggcttgaccccggtggccgttcctgcatggttatttccgtgctgttgaggaacacgacggagctcagtcctctttctggagccattatttccctccggtgccaccatgcacacggtcaggtcatctgggccagtaacctgcgtgacatcctcagttcgtcttagccctcacctttgaacctcagttatcaaatcccgttaggtctccctctttagtttcagtagccttgtggaggcagaagccacaccccggtggctggctaagtcaaagggaaggtagatggagtgcagaagaaaagggcaagatagtctgttggttggaggtgggggcaccgagtctgttctggcgcctgttggccaacctggtggaaactgttcgcaggcacctacacagaaagtggcttccatatccttggtgttctataggtggccagcagccccttctgcagccagtggactccatacccttgatttgaaaatggccagctgctttccagggcaagtgtggatgctaggcctggctggtcttcgatagtccctgtgaaataccatttcaccacccccaaggccgcaggtttttgtggacataatattttcgcgtccctggtcagtcttccagaccgcctctccaggtcacacgagatttcctcgagctctctcttctgccttcaccatccctgacagttgagatcgcctcgttccttcagccggcatcctgggctgggcaggccccagattcgggcatagattctggttccagtgaggaggtgtgtgtaggttctgccagctcccattgccaagagactgggtgttgcgaacagacaaaaacaatagaaatgcagataccattcaaggttagcgtgtgtgtgtgtgtgtgtgtgtgtgcgcgcgtgagcatgcccctgctagcacctgcttgggaatcaaattaatcgtgggtgctgtcccttgagcgagaatggactgattcatggagtggaagcagtggtgaaggatccatgaaggatcgaattcgctaaagcagggctgggatctaccctttcacaagaggtgttgttcaagtctaacacctagaaggctgtggagtgggacgaaggggacatccccaaacacagggacgggtgtcggggctctcagaatgctggaggtgccacagtaggctcctgatcctccacaggatggatgggatgtctcagcactcccgtgtgtgggtgcagtgataatacctcagagtcgctggttggtgcctcatctaggaaatggggagctcccgtgggagggcaccacgatgcccgctaaccaacacatgggcaagatacgcacagagagggtggaaagtgggaaagagagactgccctgggacagctggttgggctcggtatctgccttcccccatactccctctgtgtctccctgctgggctcatggtgtgagctcagcgagggggaccaccacgcacgtggtgggtcaatcacagacctcagacctggaaaccaacgctggtggggacctaccccatccgaatctaacccctcaccggagaggatgggcttgactccttgggccaaggctttgaccctgacacaggtggttgtttcttggggggataacacagtgggctggtgtctgggggaagacatgtgtcagggactctccagcttgggtttttgccaccggagacatctaggcaggttctggtgggggcagaactccagccccagtcactgccccggggggcatgggccatggtcgacagggtgtggaaggggagaagcccgtggacggagtcttggaaggcgtgaacccatccctcagttgctggcttttgccagccccgcctcccagcacgccacctcggttccatattcagaccaccttctgcacaataatggggccataacatgtacaccctaggcccatggtacaccgcatggtcgggcggagccttctggttctaggggatgtaagtgcagaatccgaggctcctcggattagaggaatccatctgggtcccattggacaggaggaggttgagcccttcccctcattcagtggcccccttttgcttttccctcaagcctcctctcccaccaagaggaatgtggggtctggcctggagagccttagaccccctcctgccttgtcctgccactcagctcagatgagctccagaggtctggtgagctgcgtgcctgccacagtggcggagccctgtgcagaatcccacctacacctggtgccaggactgccacaggtacatttccatatgagacctcttactttgttggcagaaaagagcatctcctcttcagactccagctagggccgaaggtgtgtgagtctcctagcacgcccgccagccagagtccccaagggtggccttccaggctgtggcggaggcccagggcaccgcacacggggatgtgagatggcaatcataggatcatagtggtcatggtgagtaccagccatgaactttagcccgcctggaacacactcctgggtgaactcggacaacctcatgcacatctgtcctcaacctccaccccaagaactcctccttttccccacacattttctcatcatgcgtttcctcgaaggatgaggccaacacttgtgtttgccaggtatggccgcggaggctgtggccgccagggtggccgtgcaaactctatctgtgggattccagggtgctccgttctcgtgatccagtgtgaacggcgcccatgtggttgtgcagttgttgaagtccgggtcactaccatgcagagcgaggaacagaaggttggcagggttttggaaccctcctgtttgccccatcctgatcactacttcccactttgcacaccacagaggaaatgactctactgacttttccaacaatcagtcactttctcttaaaggattaataattgccatttaataaccatcatcaagatataaaagttagaggcggttaaatgtaaaattacatttttgaaacataatacacccccccacgcacgcacacacccatacactctctgtctcacatacacgcacacacacgcacacggagagaactcagaagccggccatttgacaaacagttgtaaggtgatcaagccaggtagctattacccaggtcatgaaactgtacattgcacctttagggaatcgcagtccgagtgtctttctctgaaggaagccaaatgcacatgctacgtaccgtgtgattccatttatgtgacattctggaaaaggcaaaactctaggaacacaaaacagattgatggttgccagggtctgagggttaagacgaggagttcagtacaagaggacgtaagggaacctggcgggggaggggggcgggggatggcgatgctctatatctatatatattgtgctggtgtttttacagccatacgcatttacgagatctcacagacctctgtgtaagttatagcccaatagtcctgactttttagaaaaaaaaattgtcagcaatacatctcaaatggaaattgacatttagtcaataccttttgtgactatgaagagcatgcttctctctccaaatctgttaatgtggagaattataccattgtattttctgaagagaaattaagtttgtatttctgggatgaagccaatattagtcatgccatattaggtattttcctttttatatcctgtaggcttccgtgtgctaagattctggttccagtttttacttctatgtcatgagcctgtgattgatctgcaatatttctctaagtgtccctgcaggatttggtatcgaggttatgccaagctcatacagtgagtggaggattgttcctccttttcaattttctgcacgagtttgtgtcaaacggaagacaggtattcctaggatgtttttcagaatgtggtggggaatcctagagtttattagtggaaagcctttgactactcatatctttctgtaatgattctggaacggttcaggttggctgttccttcttgtgttagttttggtggattttgtttcctagcgactggttacctttttctttgttttcaaactgactgtaataaagtggtccataatatcccccttcatctcagattgcatttgttaaaattaggaagtcacagaagagttgcacagaaagccaaaggagcacccatacgtatattcttctactggatcctgcagttgttaccattttctcacatttgcttcatccctccctccatgccgcgcccccatctttttctgagcgtgtgcgtgtatttttttttttttattgttttgtggaatcatttgagatccattggaatcatttagatccatcatccgtaaatactgcagcatgtatcgcctacagggaagcatgggctcccacaaaaccttaatgccaccatgacactcaggaaatgtaacattgagaccacacaattttctactgtatgatcacatgaaacattttccgattgtccccatggtcacatagtatccctcatggctgctttctaacaaaattttctttccaaccaaacatcatgctttgcatttagtagtcaagtctcttttgagacagggtctccctctgtcgcccaggctggcttgcagggtcgtgaacctggctaagtgcagccttgacctcccaggctcaagccatcctcctgcctcagcctcctgagtaacttggactacaggcgagtgccaccatgcctggctaatttttaacatattttttgtagagacagggtttcaccgtcttgcccaggctcgtctggaactcctgagctcaagccatccgcccgcctaggtctcccaaactgttgggattacaggcgtgagccatggttcccggcccatcaagtctcttcagtgtcctttaaagtgtgctttaaagcaatgtttaaagtgtgctttaaatcactgcagctgttgtcgggaagcccttgaacttggctttgtcgagtggcttccttgtgattagattcaggtaggtttaacatttttggcaagactactgcatagcagacgtgccgtccttctcggtgcatgacatcagcagattctccatgtaggcttctctcatgactggcgatgttcatcttgaccgaccatgtggccagggcgttgttccagattactccattgtgaaggtgccatcttctctttgtatttaattagctatgtgctgttactgcatgggcactctgtgtgaatatccagttcccccacaacatcctctttctatcttttggatgtctgcatatgatatggcttggaaccgtgtccccaccaagtctcgtgtccaactgtgacttctaatgttggaggtggggcctggtcggaggtgactggatcatggggctggatttctcaggaatggtttagcagcatccacttggtactgtcctcatggttgcgaatgagttgtcatgagtctggtcgattaaaagtgtgtgacacctctcctttctctttcttgctcctgctcctgctcctatcatgtaacaggtacctgcttctgtttcaccttccgccgtgattgcaagcttcctgagtcctcccagaagcagaagccgctatgcttcccttcccgtacagcctgcagaaccatgagctcttctctttataaatgactcggtcttggatatttctatatagcaacacgagaacggacgtaacatcgtttgtgcttatttctcccttttctttcctgatagcggtgcccttctcccttgttttcttgaccagtctcacaagagttttaccaatttcattcctcttccaaacacccagcttctggttttgtgatccttatgcttgttttcgctttcactgatttctccttttaccttgatgacctccttctactttccttggtcttacgttgggcttcttttttgaacgttttctcgttaattgtctgcgatcctcttttaaatatgtgcttttagcagcctacacgtccctctcaggactcctttactggtgccgacaagggtttatgagtagtatttttgtgatcatccagttccaaatatgggaaaccatgaaaatcgcaactttcatgggacggaatgaatacattgtggtatgttaatacaatggaatactatttcagcaacggaaaagtacgaagtacaaagtactcctccatggaataataggcgcgaatcttacaaagataacatcgagggaaagaagcaagggacaacacggacatgcttaatgattccattcctataacttcaaatgacaggcaacactaacctaccttgttgaagaatgcatacttaggatataaaaccacagagaagagcaaggaaaggacaatcagaaaagtcaggatgttggtttccccttgcagtaggagtggggctgagctcaggcagggacaccccaggaggctctggggaatgctggcggtgttcttctctgggacctaggggagcgttcctgtgcaggtgcactggacaatcatttattaaactatgcacataaactgtgatgttttctttctgtacgttgcctgccaccataagcagacaaaacaatagtgctaagggaagtaacactgcattaaacaggtaagtattttataaccagaaggataaccaaaattttattttctctatttatagcagatctccttgcgagtactaatatcagtttattgatagtgatagcttgatttcaaattctcatagatttcaccaaacatcgtaggaacgatgcttacataattgtgatattaatttcgatgttttggtaaatattttatatttgggtggcaagttttcattcagaatttgtgattatgtgttggaacaccatgcacttggtacatttttctcacgggagatttgtcacctccccatccacttattctcaggggcagacgacttaggacctgagaaaaagaaattaaggcaacaacattaaggggcagcaacgcaaatttttaccttcatagtttatatcagttaattgtggtatactcacatgatggaatacctttttttttttttttttttgcaatggaaatgtacggggtattcttagggatactgtccatttttaagaaaagtccattaccaagatataacaaattacataaagttaactatcatatgatatttataaagcatactacacatatatacaagtttagaaaaccaatcgactgtgaatgaactgttgagaagtgaggaaaacacgtattgagtactgaggtcaagaaagagtacattgcagttctagaggtcttatatgtatttcattgtgctaaagacaccaaatatgaaactctacataatgtatgattccatttgtagaacattcttaaaactggaaaactacacatacagaaaactaatcagtcatttccaggtctgtggattgtgagaagtgtttaactacaaatgcgtgttatttgttattagcaatttcgaccctctttatgttgaaatgtaacatacatagagagaagttcacaatatgtgtgtgttgtttaatagtgattatcaagggcatctctacagaaacacccccatgtcacagaggagaacaccgccagcattccccaaagctcctggggtgtctctgcctgatctcagcctcattcctccttcaagaggaaaccaacacatttacttttgtgatcattctttcctcagttttctctatgatttttggtcccacgtcctatactacattcttttatctttttttttttttcctttttctggagaacggggtctcgctatattgcccaggcaggtctcgaactcctgggctcaagctatcctcccgcctcttgcctccctgagagctgggattacaggcgtgagccaccgcgcccggcctacattcttttaatactacagtatgcctgcagacgacatgttcctaaatctagaaaaccccacagtctcagccccaaagctccttaagctgataaacaacttcagcaaagtctcaggataccaaatcaatgggaacaatcactaacattcctatatgccaacaacagtcaagcagagagccaaatcaggaacacagtcccattcataattgccacacacacacacacacacacacacacacacacacacacacaagatacctgggaatacaccacaccagggaggtgaaagatctctgcaagaagaactacaaaacactgctcaaggaaatcagacatgtcacaagcaaatggaaaaacattcatgctcatggataggaagatcaatataattaaactggccatactgcccaaagcaatttgcagattcaatgtgattcctagtaagttatcattggcattcttcacagaactagaaaaactattttaaaattcatatggaactgaaaaagagcctgagtggccaaggcaatcctaagcgaaaaagaacaaagctggaggcatcacgctacccgacttcaaaatataccacgggcccacaataaccaaaacagcatggtactggtacaaaagcagacacggagtccaatggaacagaatagagagcccagaaataaagccgcacacctacaactctctgatatttgacagacctgacaaaagcaagcaatggggaaggtattctctgttcggcaaagggtgctgagataactggctagccatacatggaagactgcaactggatccctttcttacaccaggtactggtctgttctcttgctgctaataaagacatacccgagactgggtaatttataaagtaaagaagtttaatggactcacagttccacatgccttgggaggcctcacaatcgtggcagaaggcgaaggaagagcagaggtgtgtgttccatggcggcagaaaagacagcatgtgcaggggaactgccctttataaaaccatgagaactcatgagacttattcgctatcacgaggacagcacgggaaaaatccgtccccatgattcaattacctcccaccggatccctcccacaacacgtggggatcatgggagctacagctcaagaggagatttgggtggggacacagccaaagtatatcataccgtatacaacaattaactcaacatggattaaagacttaaattaaaaccccaaaatataaaaaccatggaagacaacttaggcaatcatattctggacacaggaacgagcaacgatttcatgacgaagacaccaagagcaattacaacaaaag

SEQ ID NO: 1679 - DNA, 17350 bp, artificial
  synthetic oligo
ttgttggcatataggaatgttagtgattgttcccattgatttggtatcctgagactttgctgaagttgtttatcagcttaaggagctttggggctgagactgtggggttttctagatttaggaacatgtcgtctgcaggcatactgtagtattaaaagaatgtaggccgggcgcggtggctcacgcctgtaatcccagctctcagggaggcaagaggcgggaggatagcttgagcccaggagttcgagacctgcctgggcaatatagcgagaccccgttctccagaaaaaggaaaaaaaaaaaaagataaaagaatgtagtataggacgtgggaccaaaaatcatagagaaaactgaggaaagaatgatcacaaaagtaaatgtgttggtttcctcttgaaggaggaatgaggctgagatcaggcagagacaccccaggagctttggggaatgctggcggtgttctcctctgtgacatgggggtgtttctgtagagatgcccttgataatcactattaaacaacacacacatattgtgaacttctctctatgtatgttacatttcaacataaagagggtcgaaattgctaataacaaataacacgcatttgtagttaaacacttctcacaatccacagacctggaaatgactgattagttttctgtatgtgtagttttccagttttaagaatgttctacaaatggaatcatacattatgtagagtttcatatttggtgtctttagcacaatgaaatacatataagacctctagaactgcaatgtactctttcttgacctcagtactcaatacgtgttttcctcacttctcaacagttcattcacagtcgattggttttctaaacttgtatatatgtgtagtatgctttataaatatcatatgatagttaactttatgtaatttgttatatcttggtaatggacttttcttaaaaatggacagtatccctaagaataccccgtacatttccattgcaaaaaaaaaaaaaaaaaaaggtattccatcatgtgagtataccacaattaactgatataaactatgaaggtaaaaatttgcgttgctgccccttaatgttgttgccttaatttctttttctcaggtcctaagtcgtctgcccctgagaataagtggatggggaggtgacaaatctcccgtgagaaaaatgtaccaagtgcatggtgttccaacacataatcacaaattctgaatgaaaacttgccacccaaatataaaatatttaccaaaacatcgaaattaatatcacaattatgtaagcatcgttcctacgatgtttggtgaaatctatgagaatttgaaatcaagctatcactatcaataaactgatattagtactcgcaaggagatctgctataaatagagaaaataaaattttggttatccttctggttataaaatacttacctgtttaatgcagtgttacttcccttagcactattgttttgtctgcttatggtggcaggcaacgtacagaaagaaaacatcacagtttatgtgcatagtttaataaatgattgtccagtgcacctgcacaggaacgctcccctaggtcccagagaagaacaccgccagcattccccagagcctcctggggtgtccctgcctgagctcagccccactcctactgcaaggggaaaccaacatcctgacttttctgattgtcctttccttgctcttctctgtggttttatatcctaagtatgcattcttcaacaaggtaggttagtgttgcctgtcatttgaagttataggaatggaatcattaagcatgtccgtgttgtcccttgcttctttccctcgatgttatctttgtaagattcgcgcctattattccatggaggagtactttgtacttcgtacttttccgttgctgaaatagtattccattgtattaacataccacaatgtattcattccgtcccatgaaagttgcgattttcatggtttcccatatttggaactggatgatcacaaaaatactactcataaacccttgtcggcaccagtaaaggagtcctgagagggacgtgtaggctgctaaaagcacatatttaaaagaggatcgcagacaattaacgagaaaacgttcaaaaaagaagcccaacgtaagaccaaggaaagtagaaggaggtcatcaaggtaaaaggagaaatcagtgaaagcgaaaacaagcataaggatcacaaaaccagaagctgggtgtttggaagaggaatgaaattggtaaaactcttgtgagactggtcaagaaaacaagggagaagggcaccgctatcaggaaagaaaagggagaaataagcacaaacgatgttacgtccgttctcgtgttgctatatagaaatatccaagaccgagtcatttataaagagaagagctcatggttctgcaggctgtacgggaagggaagcatagcggcttctgcttctgggaggactcaggaagcttgcaatcacggcggaaggtgaaacagaagcaggtacctgttacatgataggagcaggagcaggagcaagaaagagaaaggagaggtgtcacacacttttaatcgaccagactcatgacaactcattcgcaaccatgaggacagtaccaagtggatgctgctaaaccattcctgagaaatccagccccatgatccagtcacctccgaccaggccccacctccaacattagaagtcacagttggacacgagacttggtggggacacggttccaagccatatcatatgcagacatccaaaagatagaaagaggatgttgtgggggaactggatattcacacagagtgcccatgcagtaacagcacatagctaattaaatacaaagagaagatggcaccttcacaatggagtaatctggaacaacgccctggccacatggtcggtcaagatgaacatcgccagtcatgagagaagcctacatggagaatctgctgatgtcatgcaccgagaaggacggcacgtctgctatgcagtagtcttgccaaaaatgttaaacctacctgaatctaatcacaaggaagccactcgacaaagccaagttcaagggcttcccgacaacagctgcagtgatttaaagcacactttaaacattgctttaaagcacactttaaaggacactgaagagacttgatgggccgggaaccatggctcacgcctgtaatcccaacagtttgggagacctaggcgggcggatggcttgagctcaggagttccagacgagcctgggcaagacggtgaaaccctgtctctacaaaaaatatgttaaaaattagccaggcatggtggcactcgcctgtagtccaagttactcaggaggctgaggcaggaggatggcttgagcctgggaggtcaaggctgcacttagccaggttcacgaccctgcaagccagcctgggcgacagagggagaccctgtctcaaaagagacttgactactaaatgcaaagcatgatgtttggttggaaagaaaattttgttagaaagcagccatgagggatactatgtgaccatggggacaatcggaaaatgtttcatgtgatcatacagtagaaaattgtgtggtctcaatgttacatttcctgagtgtcatggtggcattaaggttttgtgggagcccatgcttccctgtaggcgatacatgctgcagtatttacggatgatggatctaaatgattccaatggatctcaaatgattccacaaaacaataaaaaaaaaaaaatacacgcacacgctcagaaaaagatgggggcgcggcatggagggagggatgaagcaaatgtgagaaaatggtaacaactgcaggatccagtagaagaatatacgtatgggtgctcctttggctttctgtgcaactcttctgtgacttcctaattttaacaaatgcaatctgagatgaagggggatattatggaccactttattacagtcagtttgaaaacaaagaaaaaggtaaccagtcgctaggaaacaaaatccaccaaaactaacacaagaaggaacagccaacctgaaccgttccagaatcattacagaaagatatgagtagtcaaaggctttccactaataaactctaggattccccaccacattctgaaaaacatcctaggaatacctgtcttccgtttgacacaaactcgtgcagaaaattgaaaaggaggaacaatcctccactcactgtatgagcttggcataacctcgataccaaatcctgcagggacacttagagaaatattgcagatcaatcacaggctcatgacatagaagtaaaaactggaaccagaatcttagcacacggaagcctacaggatataaaaaggaaaatacctaatatggcatgactaatattggcttcatcccagaaatacaaacttaatttctcttcagaaaatacaatggtataattctccacattaacagatttggagagagaagcatgctcttcatagtcacaaaaggtattgactaaatgtcaatttccatttgagatgtattgctgacaatttttttttctaaaaagtcaggactattgggctataacttacacagaggtctgtgagatctcgtaaatgcgtatggctgtaaaaacaccagcacaatatatatagatatagagcatcgccatcccccgcccccctcccccgccaggttcccttacgtcctcttgtactgaactcctcgtcttaaccctcagaccctggcaaccatcaatctgttttgtgttcctagagttttgccttttccagaatgtcacataaatggaatcacacggtacgtagcatgtgcatttggcttccttcagagaaagacactcggactgcgattccctaaaggtgcaatgtacagtttcatgacctgggtaatagctacctggcttgatcaccttacaactgtttgtcaaatggccggcttctgagttctctccgtgtgcgtgtgtgtgcgtgtatgtgagacagagagtgtatgggtgtgtgcgtgcgtgggggggtgtattatgtttcaaaaatgtaattttacatttaaccgcctctaacttttatatcttgatgatggttattaaatggcaattattaatcctttaagagaaagtgactgattgttggaaaagtcagtagagtcatttcctctgtggtgtgcaaagtgggaagtagtgatcaggatggggcaaacaggagggttccaaaaccctgccaaccttctgttcctcgctctgcatggtagtgacccggacttcaacaactgcacaaccacatgggcgccgttcacactggatcacgagaacggagcaccctggaatcccacagatagagtttgcacggccaccctggcggccacagcctccgcggccatacctggcaaacacaagtgttggcctcatccttcgaggaaacgcatgatgagaaaatgtgtggggaaaaggaggagttcttggggtggaggttgaggacagatgtgcatgaggttgtccgagttcacccaggagtgtgttccaggcgggctaaagttcatggctggtactcaccatgaccactatgatcctatgattgccatctcacatccccgtgtgcggtgccctgggcctccgccacagcctggaaggccacccttggggactctggctggcgggcgtgctaggagactcacacaccttcggccctagctggagtctgaagaggagatgctcttttctgccaacaaagtaagaggtctcatatggaaatgtacctgtggcagtcctggcaccaggtgtaggtgggattctgcacagggctccgccactgtggcaggcacgcagctcaccagacctctggagctcatctgagctgagtggcaggacaaggcaggagggggtctaaggctctccaggccagaccccacattcctcttggtgggagaggaggcttgagggaaaagcaaaagggggccactgaatgaggggaagggctcaacctcctcctgtccaatgggacccagatggattcctctaatccgaggagcctcggattctgcacttacatcccctagaaccagaaggctccgcccgaccatgcggtgtaccatgggcctagggtgtacatgttatggccccattattgtgcagaaggtggtctgaatatggaaccgaggtggcgtgctgggaggcggggctggcaaaagccagcaactgagggatgggttcacgccttccaagactccgtccacgggcttctccccttccacaccctgtcgaccatggcccatgccccccggggcagtgactggggctggagttctgcccccaccagaacctgcctagatgtctccggtggcaaaaacccaagctggagagtccctgacacatgtcttcccccagacaccagcccactgtgttatccccccaagaaacaaccacctgtgtcagggtcaaagccttggcccaaggagtcaagcccatcctctccggtgaggggttagattcggatggggtaggtccccaccagcgttggtttccaggtctgaggtctgtgattgacccaccacgtgcgtggtggtccccctcgctgagctcacaccatgagcccagcagggagacacagagggagtatgggggaaggcagataccgagcccaaccagctgtcccagggcagtctctctttcccactttccaccctctctgtgcgtatcttgcccatgtgttggttagcgggcatcgtggtgccctcccacgggagctccccatttcctagatgaggcaccaaccagcgactctgaggtattatcactgcacccacacacgggagtgctgagacatcccatccatcctgtggaggatcaggagcctactgtggcacctccagcattctgagagccccgacacccgtccctgtgtttggggatgtccccttcgtcccactccacagccttctaggtgttagacttgaacaacacctcttgtgaaagggtagatcccagccctgctttagcgaattcgatccttcatggatccttcaccactgcttccactccatgaatcagtccattctcgctcaagggacagcacccacgattaatttgattcccaagcaggtgctagcaggggcatgctcacgcgtgcacatgtgcgcgcgcgcgcgtgcacatgtgcgcgcgcgcgcgcgcacacacacacacacacacacacacacacgctaaccttgaatggtatctgcatttctattgtttttgtctgttcgcaacacccagtctcttggcaatgggagctggcagaacctacacacacctcctcactggaaccagaatctatgcccgaatctggggcctgcccagcccaggatgccggctgaaggaacgaggcgatctcaactgtcagggatggtgaaggcagaagagagagctcgaggaaatctcgtgtgacctggagaggcggtctggaagactgaccagggacgcgaaaatattatgtccacaaaaacctgcggccttgggggtggtgaaatggtatttcacagggactatcgaagaccagccaggcctagcatccacacttgccctggaaagcagctggccattttcaaatcaagggtatggagtccactggctgcagaaggggctgctggccacctatagaacaccaaggatatggaagccactttctgtgtaggtgcctgcgaacagtttccaccaggttggccaacaggcgccagaacagactcggtgcccccacctccaaccaacagactatcttgcccttttcttctgcactccatctaccttccctttgacttagccagccaccggggtgtggcttctgcctccacaaggctactgaaactaaagagggagacctaacgggatttgataactgaggttcaaaggtgagggctaagacgaactgaggatgtcacgcaggttactggcccagatgacctgaccgtgtgcatggtggcaccggagggaaataatggctccagaaagaggactgagctccgtcgtgttcctcaacagcacggaaataaccatgcaggaacggccaccggggtcaagccacgggggagagcaaggatgctcatgatggaaaggacagtgacaggacaaacagggacagtgaactgcaggaggaaaggttgctcaaaggaccagggtgctcaaaggaggccatcagttcctgctgaaggggagagagaatagcactgaagaaggggacctgtgagaccccaaagtgggaggagaagaggagggagcatgagcagggcgtgtacaggaaaagcaggaaatgctgctgtggccgggcagggcctcccacagcacctagacccagggcactatggtgagcccgagtgcagggctgctgctcagaggcccgcccaggcgccccgcagggagatggcccaccacagagcgccaggggaactgttcttccagcgccagggaacggagcaacacccggcacaccccaacactcccaacaatcgcagagagggcagaccacagaccacagaatatgagaacgactttatttcacactgctttgaactgcgttgggaagggggcaaatgcagcggaagagaaaaagccctggctaaggaggataaggaggaaactcgcttggctgcagctccggacgctggctccaacctgtgaaacagagcaggctcagggactggctcccagccagggccagcccacagccctcctaagctaccgggattgtgggaaggggcacggtgtgtgcaacactcacttcaaaggccctggaacttgtcgttgaagaactgcatggccgctgaaacagagaggcagaaccgggcactccagacccagggaaacagaaactcaccccctgcccccgtggggaaccacctagccctgcaaccagaaaccccaccagccctgggactgactcatccacccgtcacctgaattaaatgtggaaatgccttctaagcgggaaagtggttctcaggtgctgggccatgccagaaccgttcattcagaacgtgtttcaaagacagataagccagccagcaagcaaacaccgtacaagccataccaggcagcagttaaagggaaaacacatgcggtatctctaaccctcctaagagaaggagagttctgggactcgtggactaagtgtacacggagttcagacgacacattgctgtctgtgcacacccctagctggaaaggcacagaaggctccagggccaggctttccttggttctcttccccaaaggaaagtcagttccagtgacgccgcctgtacctacagcccacccccgccccccgcaccagcagaaagacaccgctgtccatccctgccccagccagggctccatcatacctagctgctgtgtaaggtcctcaatttccctctgcagccggatgcactagaccagcagacaccggaggaagataaatggttagtcaattctggcctcctctctcctcgtcttccctgtctcccccagcccttagtagcccccatagcctgcagcccagtggtgaggtgggttggcatgaaaccctcaatgtaaaagaggcaccctctctccgtgggatgcagaaggtggtgacggggcggggcggggggacacagaaatcagtttaacctggacacggatcccaccatctaacgtggacttctatttctaggagccacacaaagcattacccgagggcaaccctgggctcccaggggccggcggaggcctgccgccattctccagggctggggcccagcacgcctctcccactgggaccgacctccaggtccgcccagttgtcagccgacccttcggcagcggcaccttctggggaggggcgcccttggacgctgggccggtggcacgatggtggctggttcgtcagccagggaggacgagtagtccacatcgtccccttggtcgtcaactggggtgccaggccggccttcccggccccagagcaccacctttccctgctctatcaattcgctctcagactcgaagctgaagacctcgggatctgtgaacctgctctcgccctcgcggctgcctggcgcccccaaatcgaggccgtggccctggccccgtggggctccggggctggccatgcgggagccagcctgcttgccaccctccaggccgaaactggccccacaaacggctaccttgtcgggggagctcatggcgccagtctgggcagcctgggctgcggggagacggtcgtcctggtaacggcagaaggggagagccgagtcctgccaagcccggcggagcgggccacgcgacaggaacagtgaggccttcgggacaccgctgccctcaccccgggtggaagtaccagatgtccccgacagcgcgtggcttctgcgcgtgcacttgacgccagtgccgcgacttctcattggtccccctctaccaaccagcgcgccctttgttggcagaggcctctgggctttaaccaatcggaacacaggctcttggtttgccccgacacccgtcatttgactgggtggctgtgctctggtctggtcttgcggccagggggcactggagctctcgatccacctccttcttgctctcctgctgcctctggctgggaacctactttccaatgagacctcctctgtgcaccgggtgctttgcgtgcatcacgacatttactctcccaagctgatgagctgggggaaggtctccccttaatccccaccttacagatgggacactggggctcagagacgtggctctccttggaaagtaggtgcccggccagaggcagaaggacaggaagaaagaggtgatcgagagctacggtgccccctggccccaagacccgaccagagcgcagccacccagtcaaatgacgggcatggaggcaaaccaagagcctgtgtcccgattggttaaagctcaggcacctcgccccacaaagggcgtgctggttggcagacggggaccaatgagaaggctcggcgccggcgtcaagggcgcgaggaagccactcgctgtcccggacatctggtacttccgcctggggcgagggcggtggtgtcccgaaggcctcactgtttctgtcgcgtggcccgctcagctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgctgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagtaggcccttctcgccctcctctccctctttaccctcctccccccacacctcctctcttccagcacacacctgtttacccatgcctcctctgtcccttgctcgagggttgtcatcgggagcccagggacactagaatgcccgatgggtgtcttcctcataagggcacacgttaaagggagcacttcttgtgtgatggccatgcctctggacgctctgcaggggtcctgcctccgcccgcagagaggagctggggtggaaggcagggctggcagctggtttggatcgggtgatgccttaaagtgtgggctgcaaagctggggcatctaggctcatcaacttcctgattcctccttccctagctgttgcccaacccacctggcaggcggccccgggctatctcagtatccccagtgttttccctggctggcctctgcctcctggcctgaggctgactgagggagaaagtgctaatgagattaggctcaggagtctccaccttaccacaacccctccccacgtgtactcaccgccggcccccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatattctgtggtctgtggtctgccctctctgcgattgttgggagtgttgggggttgcagcgtgttgcccggttcactggcggttgaagaacagttcccctggtgctctgtggtgggccctctccctgcggggcacctgggccggcctctgagcagcagccctgcactcgggctcaccacagtgctctgggtctaggtgtgtgggggccctgcccggccacagcagcatttcctgcctttctcctacacgccttgctcacggtccctcctcttctcttcccactttggggtctcacagttccccttcttcagcgctattctccctccccttcagcaggaactgatggcctccttccagaacccgtctctctcacctttcctcctgcggttcactgtttctgttctgccctctcaccatcctttccatcgtgagcatccttgctctccccagtggcttgatgccagtggcctttcctgcatggttatttccatgctgttgaggaacaagacggagctcatcctccccgcccctcaggggcccagtcctcttccttgagccgttatgtccctccggtgccaccatgcacagggtcaggtcatctggggcaaaaacccgcttggcatcctcagttcctcttagccctcacctttgaaccttagttaccaaattctgtcagatctcctccttagcttcagtagccaggtggagacagaaaccacatcctggtgggaagctgagccaaagggaagatacctggagtgcggaagaaaagggcaagacagtctctcggttggaggtgggggcactgagtctgttctggtgcctgcgggccaacctggtggaaaccgcccgccggtagctacgcggaaggcggcttccacatccttggtgtcctatacgcagccaacagccccttctgcagccggtgggctccataccattgatttgaaaatggccagctggtttccagggcaagtgtggatgctaggcctggctgttcttggatggttcccgtgaaataccgtttcaccacccccaaggccaacaggtttttgtggacgtgattatttctgtgtccctggtcagtcttcccgaccgcctctcgaggtcacacgagatttcctagagctccctgttctgccttcaccctccctgacagttgggatcgcccgcttccttcagccagaatcctgggctgggcaggtcccagatttgggcacagattccgattccagtgaggaggtgtgtgtaggttctgccagctcccatcgccgagagacagggtgtcgaacaaggacaggagaaatacagataccattcaaggttagcgtgtgtatgtgtgtgtgcacgcccctgcaagcacccgcttgggaatcaaattaatcgggggtgctctccgttgagggagaatgggctgattcacggagtggaagcagtggtgaaggatccatgaaggatcgaattcgctaaagcggggctgggatctaccctttcacaggaggtgttgttcaattctaacacctagaaggctgtggagtgggacgaaggggacatccccaaacacagggacaggtgtcggggctctcagaatgctggaggtgccacagtaggctcccgatcctccgcgggatggatgggatgtctcagcactcccatgtgtgggtgcagtggtaatacctcagagtcgctggttggtgcctcatctagaagtggggagctcccgtgggagggtgccacgacacccgctaaccaagacatggacgggcaggatgcccacagagagggtggaaagtgggaaagagggactgccctgggacagctggtcgggcccggtgtctgccttcccccatactccctgtgcgtctccctgtgggcccatggtgtgagctcagtgagggggaccatcacgcacgtggtgggccaatcacaggcctcagacctggaaacgaacgctggtggggacctaccccatcggaatccaacaccttccctgagagggttggcttgattcctcgggccaaggctttgaccctgacacaggtggttgtttcttggggggataacacagtgggctggtgtctgggggaagacgtgcgtcagggactctccagcttgggtttttgccaccggagacatctaggcaggttctggtggcgtgagaactctagccccaggcactgccccggggggcatgggccatggtcaacagggtgtggaaggggagaagcccgtggacggagtcgtggaaggcgtgaacccatctcccggtggctgcatttgccagccccgcctctcagcacaccacctcggttccatattcagaccacctcccgcacaataatgaggctgtaacatgtacaccccaggccatgggcgggtggagccttccagttctaggggaa

SEQ ID NO: 1680 - DNA, 2200 bp, artificial
  synthetic oligo
ctgctttctaacaaaattctctttccaaccaaacatcatgctttgcatttagttgtcaagtctcttttgagacagggtctccctctgtcgcccacgctggcatgtagtgtcacgaacccggctcactgtagcctcgacctccaggctcaagccatcctcccacctcagcctcctgagtagcttggaccacaggcaagcgccaaccgctcgcctaggtctcccaaattgacgggattacgggggtgagccatgagccatggttcccggcccatcaagtctcttcagtgtcctttaaagtgtgctttttttttttttttttttttgagatggagtctccctctgttgcccaggctggagcacagtggcacgatctcggctcactgcaagctccacctcccgggttcacgccattctcctgcctcagcctcccgagtagctgggactacaggcgcccgccaccacgcccggctaattttttgtattttttagtagagacagggtttcaccgtcttaaccaggatggtctccatctcctgatctcgtgatcagcccgccttaaagtgtgctttaaaccagtgcagtcattgtcaggaagcccttgaacgtaggtttgtcgaatggcttccttgtgattagattcaggtaggtataacatttttggcaggactactgcatagcagacatgctgttcttctcagtgcacgacatcagcagattctccatgtcggtttgtctcatgactggcgatgttcatcttgaccatgtgctcagggcgctgttccagattaccccattgtgaaagtgccatcttctctttgtatttaattagctatgcgctgttactgcatgggcactctgtgtgaatatccagttcccccacaatatcttctttctatcttttggatgtctgcatatgatatggcttggaaccgtgtccccaccaagtcttctgtcaaactgtgacttctaatgctggaggtggggcctggtgggaggtgactggatcatggggctggatttctcaggaatggtttagcagcatccacttggtactgtccctgtggtcgcgagtgagttgtcatgagtctggttgtttaaaagtgtgtgacacctccccctgttctctctctcttgctcctgctcctaccatgtaacaagtacctgctcctgttttgccttctgccatgattgcaagtttcctgagtcctcctagaagcagaagccgctatgctaccagtacagcctgcagaaccatgagctcttctctttataaatgactcggtcttggatatttctatatagcaacacgagaacggacgtaacatcgtttgtgcttatttctcccttttctttcctgatagcggtgcccttctcccttgttttcttgaccagtctcacaagaggtttaccaatttcattcttcttccaaacacccaacttctggttttgtgatccttatgcttgtttccactttcactgatttctgcttttaccttgatgacttccttctactttccttggtcttacgttgggcttctttttcgaacgttttctctttaattgtctgcgatcctcttttaaatatatgcttttagcagcctacacgtccctctcaggactcctttactggtgccgacaagggtttatgagtagtatttttgtaatcatccagtcccaaatatgggaaacaatgaaaatcacaacttccatgggacggaatgaatacattgtggtatgttaatacaatggaatactatttcagcaacggaaaagtacaaagtactcctccatggaataataggcgcgaatcttacaaagataacatcgagggaaagaagcaagggacaacacggacatgcttaatgattccattcctataacttcaaatgacaggcaacactaacctaccttgttgaagaatgcatacttaggatataaaaccacagagaagagcaaggaaaggacaatcagaaaagtcaggatgttggtttccccttgcagtaggagtggggctgagctcaggcagggacaccccaggaggctctggggaatgctggcggtgttcttctctgggacctaggggagcgttcctgtgcaggtgcactggacaatcatttattaaactatgcacataaactgtgatgttttctttctgtacgttgcctgccaccataagcagacaaaacaatagtgctaaggg

SEQ ID NO: 1681 - DNA, 1650 bp, artificial
  synthetic oligo
ggagcaggaaaaataacgaatgggtactaggcttaatcactgggtgacgaaacaatttctacaagaaacccccacgacacaagtttacctatgtaacaaacctgtacatgtacctctgaacttaaaataaaagttcaattcaagaaataagaataatatggtttggtgttgactgttatgtacttttatattagtggaatcagaaaatatgttcatatttcttgcttcttgtgtttaatgtcaggagtttggttttggatatttaaatttgagatgcctattaggtatccacgtggagaagctgagtagacaaaggtctggatctgggctgaagaaatacatatgagagtcatcgtagtatcgatttttttttttcagggcccatcgcagagcttatagcttgcagtgaacgccaagaatgagttctcagacaaatccagctgaggggggccgggggcagctcttctaagagactccgccccagcatctgtccgccaagtattcattgaaagggcttgttagaccacaaacatccactagatggcctttttgaggtcgggtcatgagacacctgtggcctggtaaaagcactcaaaccgcattctcgggaggctgttttcagcgttccttatcacaccacacactccactccccgtcctgttttcagggtcaaggagtttcattctcatgcacaaataacatacacacagtgcctcagtatgtttccatgccccgacctcaaacgccttgtacataagcttgaatatgctgtcgtgcaccccgccatattccccccttctttaattcttatagcgtgctggtcatccaatgcaaggtaagcttccatgattcttccctggtcatagatgcgtcgggtggcagcacagagccatctgcaagtgcctagcaaacagatacaaaaaagaataagtacagcggccatcacccaaatgcgtatgtttaacccagacaaccaagtgttcgggtttaaccattgaaagccttcttgtaattgctgaaggatacttgtttgtaattgctgcgaccattcttcaaggtgtttctttaattcacactcaagaatggaaatttgagaagacaaatggtcgtgataagccccttgcagatgtgctttcactctctcccaagcatattgggagctattatatggcagaggcgtgacacagatagaattatattgccaatcaacaatgtaaattttgatgggtaatgaatgcctgctgctgattccccagttattcaacagcggcttcaagagaccgggcgagacagaatggttttatctatatttacctgttcttgaaattcacgggttacattatacaccatgtggttcaccactgaggctgtgtgaatagattctgtcagagaaacagctgcagtagcagcagttgctaatataataatagctgagactaaaaaggcaattaaagtggccaggaatcttttttttttttttttttccgagtatgagatagtgattttctaaatagctgcagggtggaatctccttttcagctccaggttaaatttacaggcagccacaattctgcacgccattttaagatcatgacataggttatatccaactgtgtaatgtttcgatggacaagcatgcagcataccaac

SEQ ID NO: 1682 - DNA, 2100 bp, artificial
  synthetic oligo
aatgcaggtccttttaagggtggaggaaagaagggcaatggcttttctacagggggaggaaaaggctcccgtccgtccttatcctcactaaaaaaaaaaaaaaaaaaaaaaatcctccttatgccctacagaagggaatgaggtagagagaggagcacccccaccccccaaccactgttctggttcctgtttgtcctcactagaaaaaaacctcttccttattccccatagaacggaatgaagtggggagaggaatctctcccttcaaatcttctgaattcttttcaggtggagataatgggcgatctaaccacgatctggcagataaagaggatacaacgcagagcgtaccagcgcccaggtggtcaaaatagtaacattagtaaaatgaccctgctcatatcctcttttcaggcagcgacctacctgctctcataaccctaaatctaaggttccttgatcaggaaaccaagggcatttctgccaaattaaaagcataagcttgtgtagagctccaggctctacagtgcactggatagccttaagtagctgttgcactgttttaaaaaatactttctgttctttggtcatttcctgacccatgataacccaacccgcgatagtttacgcatgggtcccgtcctcctgatgggagtcaggactgtcccttaccaggattccccgaaaagtaatgagctctcctccttcacgcgtaacttcaaggcgatcacgtcggggtcaccacttgcagagcttatagcttgcagtgaacgccaagaatgagttctcagacaaatccagctgaggggggccgggggcagctcttctaagagactccgccccagcatctgtccgccaagtattcattgaaagggcttgttagaccacaaacatccactagatggcctttttgaggtcgggtcatgagacacctgtggcctggtaaaagcactcaaaccgcattctcgggaggctgttttcagcgttccttatcacaccacacactccactccccgtcctgttttcagggtcaaggagtttcattctcatgcacaaataacatacacacagtgcctcagtatgtttccatgccccgacctcaaacgccttgtacataagcttgaatatgttgccgtgcacccccgacacccactccagagacagaaattacaccacttttctattgagttatgttaaaatacacgtaacataaaatttaccatcttaagtgtttttcagttttgggttcagtagtgttaagtatatttgcattgctgtgcagccaatctccagcatgtcttcaactgcaaaactgaaatgtatacccattaaacaactcctcatttttccctgccccgcagcctctggaaaccaccattctacctgccgtttctgagtttgaatattttagatcccgtatataggcggaatcatgtagtatttgtccttttgtgactggctcatttcatagcataaggtcctaaaattttatccacgttgtagcctgtatcagaactccatccttttacaggtcaaatcgtaattcattgtaagggccaaatagtggaccacatttagtttctgtattcacccatcagtggacacttgggttgcttccatctcttggctctcatgaataatgctgctatgagcacggatgtacaaatatctctgagactctgatttctattttttcgatatagacacagaatggaattactggatcatatggtaattctctttttagttttctgagtaaccgccatactgttttccacagcagctgtgccattttacattcccaccaacagtgcacaaaggttccagtttctgcacatcttcaccagtatcacatcagttttattgaacaaatggaatttatttcatttctttgtattttgtttttgtttatttgtaatgacacaatcgtatacatttgtagtgtacaacatgatgatttgaaatacgtatacattgtgcaatggctaaattaggctaactacaatatgtatgaactcacatacctttcatcttctgtggtgagaacacttaaaatctaccctcttaacaattttcaaggatacattattattaactata

SEQ ID NO: 1683 - DNA, 2550 bp, artificial
  synthetic oligo
atgtcctgaagattcattcatgttgtatcatatgacaggatttccttttttaaaggccaaataatagttcattggatgtatatgccaccttgtaaaaatccatgcatccattcatggagagtcaggttgtttctacctcctggctattgtgaataatactgccatgaatatgggtgtgcaaatacgtattcaagatcctttttcaggtcttctggatatatacccagaagtcggattgatggatcatattgaagtaattctatttttaaattttggagaaattcccatactgtttttaataatgggtgcaccatccccagtagtgtacaaggattccagtttctggggtttttttttttcttaatagtggccatcccaacaagcatgaggtgatattgtggttctcatttgtatttccctgatgattagtatcttagtcaattcaggctgctataacaaagtaccatagactggatggcttaaagaacaaatgtttatttcccacagttctgcagactgggaagttcaaggtaaaggtgctggcagattcagtgtctggtgacggccctcttcatgatgcatgagaagcaccgggctcacagaggagctgcaagcctctgttccacacaaagagctagaacctgatagaaacatgggcagggaggctcacagtcaagaagcaggggttttaggtttgtttctgctagtgctgtgaaaaacaccattgtcgatttcctagggactcactgcattgaacgtgtaacggctttgtgtagcacctacgtgttaaccgtcttcccgtccatgaacacgggatgtgtctgcatttattggtcttctgcgtgtttcatcagtgtttgattggtttcagtgtgcacacctttcacctccctgaataaacgtattccaagggttttattcttgtcctggtattctaaatatgttggtttcccgggtgtctttttcgcatagtttgttgttcgggcatagaaaagcgagtgattttcacatgttgcttttcactctgtaactttgctgagtttgtttattggttttgaccattttttggtgcagtgtatatcagggttttctctaggtgagatcatgtcatctgcaagccgagaaaattgagcttcttagtttccaatttgaatcctttttatttcttttcttaaaataggtgatcaaatcggcacgtggctgtgcccacgagggttgtttggcatgtgggtgtgctggtttggcaggccagaaatttttatttctaagagtttatcccactccacacccttctaggttttagaattgaaaaaatacctcttgtttaaggtagatcccagccctgcttttacgcgttggatccttcgcggatccttcaccactgccttcactatgtgaatcagccctttctccctcaagggagagcatctccgattaatttgattcccaagtgggggcatacatgggcaccagcccatatgcgtgcgtgcatgcgtgcacgcacacgcacgcgcacacatgcacacacacgggacacacaaccacgtgtcgatttggtcatgtgttgtaagaaaaagaaataaaaggcgccaaactagacagtaagaagctcaattatctctgcttgctgatggcatgaagtcacatagagaaaaccctgatgtgcactgcaccaaaaaacgatcaaaaccaatagacaaagtcagcaaagttgcggaatggaaaagcaacatgcgaaaatctctcgcttttctatgcctgaacaacaaactatcccaaaaagacacccgggaaaccaacatatttagaatatcaggccaagaataaaacccttggaatacgtttattcagggaggtgaaaggtgtgcacactgaaaccgatcaaacactgatgaaacaggcagaagaccaaaaaatagagacacatcctgtgttcacggacgggaagacggttaacacataggtgctacccaaagctgttacacattcaatgcagtgagtccctaggaaatcgacaatggtgtttttcacagcactagcagaaacaaacctaaaacccctgcttcttgactgtgagcctccctgtgagccttgactgtgagctacccaaagctgttacaggtaaaacgcagtgagtcatgccaccgcccagcatccagggacaactgtccctagaaggcatcactgccaaagggtccgctgacattggggcagacctggaggtcggtcccagtgggagaggtgtgctgggccccagcccggggaaatggcagcggaggaacttcgtcggccctctccacctcactggtcctgggacaggcccagcctgagagaacccggaaaggggcttgaagaggagacgcagcatctgcgtggatccccagcagccctccgaggaagggcccgcagggctgtctacccaagactctgattccggagatgagtgcagcgacttaccgttgatcagggtgatcattttcaccaaagaaggaatccaggccaagcccggaagccccaagaagccagcagacacttgcagacgccccagtt

SEQ ID NO: 1684 - DNA, 1650 bp, artificial
  synthetic oligo
tttcccgcgtgtctttttttggataatttgctgttagggcatagaaatgccagtgattttcgcatgttgcttttccattctgcaattttgctgactttgtctattggctttgaacgttttttggtgcagtgtatgctagggtttttttccatgtgagatcatgtcatctgcaggcagagataattgagcttcttactttgcaatttggatgcctttttttttctttttcttagaataggtgatcaaattggcacgtggctgtgtgcccacaagggttgattggcctgtgggtatggtggtttggcaggccagagctttcccacctctcccagcctccccaagcccactgtcgtttattcaacgaagccggaagtccaaccaatggtctaggataccccaaagatgctcaccatcactcaccttaaaggtgcaaactaaaatcaaaactcaatttacacacggcaggtttgtgactcttagagagcttaaccattccgggggtaggagaggtcctgagcaaaccagtgcatttgctcacttgctgggggaaagggggagggcggccacttgggagggtaatttggcaggatccgtgaaactcaacttatgcatcattcactatgtgcctggctgtcttctgggccttatcgctacatgttaactcatactcgggacagttttaggtggaagtacctgctattgccaccttcttacaggtggagaagtgggcacagagaggttcaggacttgctcaaggtcatttgtttggctggtgggtgtcagctgcaggtcagaaaccaggcaggtgggctccatggagttcgtgcttagagctgagcctcctaaaactgcaaaacacatttgcaaggctgttaaatcccacgacaccagaaagtgcctgtagtcgagtagacttgcttatctagtcatatattccagccccttgatccagcctcttaaagtccattcgcggggtatttccctgtctcctgcctgtacaggctatctcttgcttggcatataatctccattctccctttatccggctcagcatcacccagcgaggtgacagagagcatatggggcagcccctgagggaggcacccttggctttgtggggcccagggctgtgtagcacctaccagcatggggtccggggtagctcttgctaggacaggaaggctcacctttcacacactccatccagccatccccatcccatagttcaggtgactgggtttctccaaacacggccctgaccttagcataacaggcctgtgttgcttgagggtgccatcatctctggagttctgtgtcatttgctatcaaattatgttgatgtggtgctcctcagttgtgtctgctcgtcttctgcaagaggtgaggctcttcttggaagcaaccaaagaggccttttgggtcttacactacaataaatacctaactttggcccggcgtggcggctcacgcctgtaatcccagcactttgggaggctgaggccggtggatcacctgaggttgggagttcaagaccagcctgaccaacatggagaaaccctgtctttgctaaaaatacaaaattagtcaggcgtggtgactcatgcctttaatcccagctactcgggaggctggggcaggagaatcacttga

SEQ ID NO: 1685 - DNA, 1050 bp, artificial
  synthetic oligo
aagcacacctcgagctctggaatcagaggttactggttaatctaggccctcccctgcttcttatctgcttgaccccggccctcgcctcaccgttcccccgcccagtttccctcttgttaaggtggtgtgataaaaacgacccctatcccgggttagaggtgaaaactcaacgcgacaagtggaggagagcgggcttttagcgccagaagcttccatgatgcccaggtccgcgggcagggcgagggcacgggccggggaagcaagcgttgccgcgccgctaccgtcgggggccggcccccgggctgcttttcgtgcgcggagcagctcggccagtcaccaggcgcgtgcggaggcggcgagcctgcgagggcggccggtgcgggcgcagccggcgcgatgagtcaccatccctcagcacctccggaacacgaggctgcttggaagcagccgggcccccgcccgccctcctcccccgccccgcggagtggcggcgccagcccgatgcccggcagagggcgctgcagtgcggctgcggggccaccggcccgcgctgctctggctgccaaaggccggcgctgcctttggctcagagggaaagatcggggcccagggatggggtgcgtgaggaatgaatgtttctgcagtgccagaggtggctctgtttttgatccagaaacgaaatggacttcaagattcagacactgggcagagtgatggggccgacacggcccctactggagagtgtccagtcttgatcgccccaagcttttgagcagggatgtcctgtccgaggctggtgtcgtccccactctcgccagagaggatctgtgataggatgagtctcgcctttccaaaatgaatctgcctaaggacccagtccttgatctcctctgtgacctctttcacctgaggtgatggaggttacgaagattggagctgtctgcagtggagcgcaggagaaagtgcacaagctttcgggtgaccagggtttcagtgccagctccatcatgagattgctgtgtgaccttggtcatttcattattcattcat

SEQ ID NO: 1686 - DNA, 1750 bp, artificial
  synthetic oligo
gggtccaaatgttttatgtatggctcatttactcattggattctggcccccagctataaattctctgcaggccatggctggggtgggatgaaagctaaaggaacatgagaacggtgaggtgaggtcgtgcgctcgggagccacccacgctggatgctgctagccttctgttttcccgcaaccctcaggtctgggtttccctacaaggtctgccagccctgacagaaacagctgctacagatcccaagtgctttctctctgcaaagcaggaatacactggcctacagtggagactggaagtgtctggaggccttgtctggggacaagggccttgcaggcatcatggatgaagccaccctctcaggccctgcccccagatgttctacttttctatcccgatctctctcttcaatccctagtccctgtgatttcagcaggaaaatatctagaattgtgttcaaaccacagggtcaggcagagtgaacttgtttttgaaacaaaaacctgaagctctgctctttgggctctgagtgaatgtggctctgcagtggccggcagcccggtgtgctacctctgcgagagattggcagtcccagttcacccccattggggtctaggatgaaccagtcaccagctaagtttctggcctcactgcttcctcacgccctaccctgcctcatgtccacttcctctctgaagacaggactcagttgttctctgtcttctttgcttgtgagttggtcctagctccccactctttttcaggccagtagctgcctggggtgtaagggctagactagggtggtgtgtcctggagctagaaggggggttagaactggaccacacctaattgtcggcagtaatgggaggagcttgaggcagaggatttaagaggcagactcttgggaagaggctgaaaagcagagtgtctggccaagaagacaatccctgagccaaaaaaaaaaaaaaaggagctgcaaggactttgtagagtaagcaaggagccttgggcctggatggaagatgtgggcctatattgtgtgcccggtgcattgtaggtgctttgttgaataaataaatgaaggaaggaatgaaccaggtgtagacatgtaatttaaggttctcccacacccaagtcaggtagctttcctgttcagaagtttttggttaccctctcactccccacacatctgttctgtgccaggcctggactaggtatgtagggtggcgaggcaaagagagaggggagtgggactcagtcctgccgctgaggttcccacaattgatgtggggaagatgggcatggccacacacagctgcaatgcgctgtttcctgacttttgtgagtctcaactcctgcagacctgctacctctttctacagccaacttactagcacttcctttactaccctaaaatgaaactcctagaaaatataacccatgcacacacataatttcaccctgaagacactgcttgaggtctctgcaaattgaactaggttaaactttggacatcagtatcaatcacatgctaaatgttattaatgatattattaatattaatatatattgcttattgagaatgtcctgtgttgccaggtactttctacatattgttttaatctttgtactaactccatgaggtagacaatgttaccatccccattttacacacaaggaaagagaggtaatgaaaagtttccttaggaaattgcctgaagccacacagtaaatggctgagccgggattc

SEQ ID NO: 1687 - DNA, 1550 bp, artificial
  synthetic oligo
agagcttaagagccacatgtggcttctggctaccgtattgaacagtggaagttgagcaggcagagagattcaaaatgtcacctgagctgtgtgtctctgtggttggtaggaatggattagaaggtcagacattgaggacaaaatcctcaacttcaccactcaaggcaactcatgaagcttctcagggtcttggtttgtggactccaataaattcaacgtatgctggttgagtgcagaccagaacagccgagccaagtacagtcaggcctcgcttcacaatggggatacgctacgagagaaatgcgtcattaggtgatttcctcattgtgcaaacatcatagagtgtacttacacagacctagatagtgtagcctgctgcacacctaggctatatggtacagcctatggctccaaggctacaaacccatacagcacgtgactgtgctgaatactacaggcagttgtaacacgatggtacttatctgtgtatctaaacataactaaacctagaaaagatagagcaaaactatggtatcatctaatggggccactgtcatatatgcagttgtcatatatgcagtccattaagcaggggtcctcaacccctgggccatggacccgtaccagtccatgacctgttaagaactgggtcacacagcaggaggtgagtggcaggcgggcgagcattaccgcctgagctccacctcctgtcagatcagcagcggcattagattctcataggagcaggaaccctactgtgagctgtgcatgtgagggatctcaattacttgctccttataagaatctaactaatgcctgatgatctgaggtggaacagtttcatcctgaatccatgcccccacccaagtccgtggagaaattgtcttccacaaaaccagtccctagtgccaaaaaggttggggactgctgtgttaacttacatgccattatgtggcatattgctgtacaaatggccctggcctttccacaagccgtagcatggccacagagatatagaaagagcctgagtgctcacgaggtgattatctgaggtctgtcacaggttcccctttctttgctttcagaggcatctctgttcacagcgtctcatcacactcaaaacccaatgcctgtttccttttttttttttttttcaaaagcagagtgtgtggcaacggggctctgaggaaatccctaccactgtggttggggagggtgtggtgtgaagaacccacattgtggcttactcaactgtgagatcttaactctgtggccccagagccactgtgctcctgggcggcagtggtgacagccatggcggcacagcttagagcctggaatggtaagcatgggctcaattgcatcctgcaagaagactcgcatcagggtttgagctcggggtttggtgtctgggtgggtgtcggcagaatgggaggaggcaggtggctggagagcactggggacaggtggagcagccagttttgccctggcctgagtcaggccaggtttgggaagcatttggactccacagcaggcttgggtgctcggcc

SEQ ID NO: 1688 - DNA, 4300 bp, artificial
  synthetic oligo
aatggcagaatgatcgttgctgcttctttctcctcctcctcttcttcctccttctcctctccggaaccctaactggctaccctttaggcaacatcaaggaaagttgtggagcctgcaatgttgggcgctgtccaccgggggtgcccaggagggcaatgtggtgagaggaaagggctccagatgtgtggcaagtcagtccaagagccctgatacaggaatctgtgcaaaggtaaactcaagtgctgtaagtggaaccagcctgcacagtcagtcaagggcaaatctccgtcaagttgtccatttgacatgtggctttgcacactctcactgggctagatgtcgggtcctcttccaggccctctgctggaggtgtggcatgaaatgagtgtaggattctagggacatttctggataccatcctgctcaccatcgattatatctagcaactggcctcagtggctttaggagttcagggtagcctgtcctcttgctcattggggcagatcagtgaggcattgggtgaagtcctggtgggtcagtcagagaataaaactgtagaacatagggtgaagaaacgcaggagaggtgagggttaggaacaaccagaggggaaatacaagagggtgaccagttcatttatgggaacaggcccagaaacttgctctccagctcgtggccggactgagcagagtacatgccaagagggcagctattgctgatccctcctttcccaggtggccctggttgggcacacgtcgctctctggtcacggttgcaagatggtctggaattctgcaggtcttcttcaggttctgcaggtctgaaactccctgaagtcctggtcagcaaatggggcaggtatggcagcaatagcaggggcgggggatgcaaaagaagggtgtgttctgggtggccatctggccccagcactcaaactcgaattcggccacgagcagctcggtggcccccctgtctcggagtgaggcggaaaagcacaggggggcgtcttcgaacttggcgttgtcctaaacgacctgtgcggcgaatcagttggggggagctgtagaatggtgaattggtgcctggaaggccttccagaagtgggactcgattctggttcctccgtctgctaggctgtattatgggaggtgatgcacccaggaagttttcggcgtggtaaccacttgtggggccagaagtctgggatgacgcgtgaacaaaggtcggctccatctccatcagctcatctaggtcatcatcttgggcctcatccagtggctcctcctccacctcaccataggtctcctcagtccctggatcctgctgtggctctccttctggtttctggcccccatcctcatcttcatcttcttcatccttactctctccttcctcctcattcttgttccttatctcctcctcctcctctttctgtttcatttcctcttcctcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgtgttcagataacaaaggacttgccacacagaaaaagagtcgatgtgctctgtgttgctaccatggcagaattaggaccagtgggtggaaacccagaaggaggcacattccacctccagataaggaagaactttctgacacacctgacagccccaact

SEQ ID NO: 1689 - DNA, 1050 bp, artificial
  synthetic oligo
aaataaataaataaataaataaataaataaataaataaataaatttatttgccattttggccattcttacatatacaattccttggcattaagcacattcacaatgctgtgcaatcatcaccactagccagttccagaattttttttattttcccaagcagaaactcagtacccattaaaaaataactccccatttcccatacccttaacccctggtaacctctattcaactttctgtctccatgaatcttctcattctaagtatctcatataggaggaataataaatatttgtccttttgtatctgggttgtttcacttatcagaatatcttcaaggttcatctacattgtagcatgtatcagaatttcatttttatgtctgttaatattccattgtatgcatatgccacattttgtgtatccatgatctgttgatgtacacttgggttgtttccatgttttggctattgtgtataatgctgctatgaatgttggtatacaagtatcaatttgagtttctgctttcaattcttttggatataaacccagaagtggaattgctggatcatatggtaattgtatgcttaagtttttgaggaactgccagactcagtggctgcattatttcacatttcccccagcaatgcacagggttccgaatttctccatgtgctcaccaacacttgttattttccatttttgtttttcataattgccatactaacgggtatgaaatggtattgcattgtggttttggtttgtatttccctaatgaatgatgttgagcatcttttcttgtgtttattggccatttatattatactttctttggagaaatatctattaaagtgctttgcccatctttaagctgtttctttttaattggtgttgttgagttttaggagttctttatatattctggacattaatcccttatcagatatgatatggtttagctctgtgtccccacccaaatctcatcttgaattatactcccgtaattcccatgtgttgtgggagggtctcagtgggagatcatttgaatcatg

SEQ ID NO: 1690 - DNA, 1100 bp, artificial
  synthetic oligo
ttttgttttctttttgttttttgtagagatggggtctctttatgctgcctaagcttgtctcaaactcctgggatcaagtgatcctcctgtctttgagtcccaaagtgctgggattacaggggtgagccattgctcctggtcccttttctgttttcgaaatgtaagcatttggtgctataaacttctctgctttacctgcattccacaagttttgatatgtcgtattttcattgtcattcagttcaatatattttttagaaatttcctttgagacttcctttttgacccatggattatttagaaatatgctgttcagttttcaagttttaaaagacttttttgttatctttgttattgatttctagcttgattccattatagccagagaatacattctgtatgatttcacttcttttaaatgtattaaggtttgtttctgaacccgcatatgatccatcttggtcagtgctccatgaatacttggaaagaacgtgtattttctgttgctggataaagtattctataaatgtcaattagatcctcttggttgatggttttgttgagttcttctatatccttgctgaatttgtctagtcattttaccaattgctgagagagggagttgagccctccaactctaactggggatctatctattttgttgttcagctctcttggttttcgcttcatgtattttgaagctctgttgtttgacgcaaacacttaggattgctacgtctttttggtggattgatcctttaaacacgtctcttttgtccttagtaactttctttgctctgaagtctattttatctgatattaatataatcatttttgctttttaaaattaatgtttgtatgatatatcatttttccatccttgtgctttcaacctacctatgttggcatgtttgaagtgagttttctgtagacagcgtatagttgagttgtgctttttagacttttttctttttttttttcagagatggtgtctcgctatgttgcctaggctaggcttgaactcctccttcctcagctggaattacagatgcgcacgaccacacccagctgggtcgggctttttttttttttgggagaca

SEQ ID NO: 1691 - DNA, 2350 bp, artificial
  synthetic oligo
tcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtc

SEQ ID NO: 1692 - DNA, 1150 bp, artificial
  synthetic oligo
tctaaccggtatgctgttaagagatacttgcatcatttccaatcttttgctgttataaaaaagctgaaattaagaacactgtacatattttatatgtgttcagatatattggcaaacactcaaaaattgaattgctggttctatggaaaattatgtatttgtaattttttaaataccactcagactgcgttttctacctcttagtctcctgatggaaaagaagaacgattatcagtggcaaatggcagtttcagcgaagcaacaccaacagccggcttcacactcactagagaatgctgtgcctcctccttgtggtttctggcaccctacacattcagagaaactactctagtaatgaactatagaaattacccctgaaagtatagcccttattcttagttttgatagataatgccaaattgccctttattggagtttatactacccattaggaatgtatgagagtgtttacttttccacagctttggtaataaaacgagttattaattttgggggtggttgccaatctttgtattttgcttctttctttctttctttctttctttcttctaacaacatgggtacatttctgttagactacctgatacagaagatagcgtggtatggatgcatagcatgaataacaaatgataccaatgcactttatttgaaataaacaaaaatgcttacacagctcaatgggccacttggaaacaaactgttgcttgactgtgttactgagcaaaaacaaagtcaaagcacaaacacccttattttttgacatgtatttggagataggtaggaagacactacctggttctttaaaaaactgttctttccttaaggcctggtcatagaagtgtaaagaatgtaaatgaacttgccattaccaattatcatatcatatctatgtcggctgtgtattctgagatcacacacaaacctgtgtataaccagtatacctgggaagagctgctataccacagttatacttgagttcttgccaggcgggacagaggaagagtaatctggagtaagttttacatcctgtttagaataaatcactagtattcccttaaatgacaggttagaatagaaagatgctacctggaagttatcctttttactttggttcgtttttagtttttgt

SEQ ID NO: 1693 - DNA, 1850 bp, artificial
  synthetic oligo
tagtaaaagaggaaggaatgcctctttgcagttgagataagaggaaggcatctgtctcctgctcgtccctgggcaatggaatgtctcagtgtaaagcccgattgtatattccatctactgagatggggaaaactgccttagggctggaggtgggacatactggtagcaatactgctctttaaggcattgagatgtttatgtatatgcacatcaaaagcacagcacttttttctttaccttgtttatgatgcagagacatttgttcatgtgtttacctgctgaccttctctccactattatcctattgtcctgccacatccctctctccgggaaatgcccgataatgatcaataaatactaagggaactcagaggctggtgccagcgcgggtcctccgtatgctgaacgccggtaccctgggcccatttttctttctctatactttgtctctgtgtctctttcttttccaagtccctcgttccacctaacgagaaatgcccacaggtgtggaggggcaacccatcccttcaagtcagctttcagaataccaaacattcctagttttccttctattccacatcagttgctctttcttattctgctgatcccttccctccttcccaatctactgatactgaaatgccccagggcttactccttgaatcgccttttactactctaactagaacaatcatttgcttggtgctctcattcagtctcaggctttagataccatccatacgacaatgactcccaaatgcattactccagaacagacgtatcccttgaactccaggtttatatattcaacttcctactcatcttttcttgaatgtcaaatagacatctcaaagtgctgggattacaggcgtgagctaccaggcccgacatctcaaatttagtgtggtcaaaattaaattcctgatctatcccctccaaaacgactctgtccacagtgttcccatctaagttgatggaaactctattcttccagtaattaaagccaaaatccttggagtcattcttaactcctctctttctttcccacgcatttgcaaactcttagggagtccgactggttctaacctcaaaatatatccagaaggctaccatttttcatgacctctgctgatatcaccttggtttgaaccaatgtcatctctcacttacattactgcaaaagcctcttaagtggttttcctgattctgtgcttgtttctttccccaaagcctgtcttcaacacagcagtcggagcgataagatatgacatcatattatattaaaacattagctaatacagcatttcttttatcaaaatcctgcatgacccctcacccatagacagagtaaagcacacaattattatatatctttaaatttttttttctttccaacttttattttaggttcaaggggtatatatgcacgtttgttacatggatatattgcataatgctgaggtttgggtttctcttgaacccatcactcatattgtgaacatattgcacaattggtagtttttcaacccttgccccacttcctccctaccccctttttggagtccccactgtctattgttttcatctttgtgtacatgtctacccattgtttagctcccacttataaatgagaacatgcagtatttgattttctgttgttgcgttaattcacttaggataatggccttcggaggcattcatgttgctgcaaaggacataatctcattacttttatggccgcatagtattccgtgatgtatatgtatcacattttctttatctaatccaccattgataggcacctagtttgattccatgactttgctattgtcaatagtgctgcgatgagc

SEQ ID NO: 1694 - DNA, 1600 bp, artificial
  synthetic oligo
agcggcagaaaagtttgcagcaaccaagccgacaaggtccgcccaggccggcagcatcccccaccccaccggcaaaggagggagtgagtggagcagacacaggcaaagcctaagcaagtacaacgcggctgccgcccaagacctgcaaccgctgccctctggctctgagggcagcccatagcaaaatttcatgtgttacatcccaggctatgattgtttgctaatattttagtaaaatgtaagaaattgaaaaacctcttttctaataatggccactattgttatcgctctcctacccctgacgtagctttccaaattcaatttaattaaaacagtaacctctaaagggagagagattacagagggcccatgaattagttaaagagtaattaaaagctaagcatgtaaaaccacacattaccctttaaaagagaactttaaacctaattaaatgatatttgttaaattagaaggtaaaaatgtcatgtccttctcagaaagtgaagaaaagttgtatgtaagtgtactgaaaactcatgcatgaacgactgtcttaactcactgattacagatagtctttgatttgtacttgctaagagagtcctaaattgagttccccagctagtgagtcactgttttcaagactgtttgccagattaaagtccataaacttggtcagcctgaaaactcaattacaagatttaagctattctgcctgtggctttaagcacatggttaaagtatattatttcagtctctgcttctagagatgctttcagattttctttttaaacttcttgttacttatttcagcttgccatcttaataattaatgcagtcatttgctaagttatgaccctgatatcatcaggattcctttaagtaaaaggcaattcaaagcggtattgcactcccccatacctaatgttttaacactgtttactgatgggtctggtaaatatggaaaagcggcagtctagtagagaccacataattcaatcactcaatctgagtttactagcactcacagagctaaggttactctgtttatttatcaaagaacttttacaaccttaagctcgctctggactttccagccttatgttgcaaatataaccgtcaattaatggggtcaagacttacagcatgggatatgagacttacaaatgaaaactttgataatccagtatttaaaatgttgaagaacatgtgatatcacagtgggaaaggtttggggaggtttctacagtgaaatcctaacccgatatcagtaactggaaaaacagatagaaaagcgctaggaggtcaggatttctgatgggggtcattgatatttctcctccgcccactgccttaccattagaatggcttagtgacaaacctgtatgggtggatcaatggcccctaacacaggagaagctagatcaacttcatctgttggcaaaagagcaactgaatgcaggaaatatagaaaagtcagttagctcctggaattcaccggtatttgttgtcccaaaaaggtccaaaaacaataatgatctctggggtttcagctcaacgctcagagctaattgcagtcattcaggttttatagctcaca

SEQ ID NO: 1695 - DNA, 1350 bp, artificial
  synthetic oligo
aaaaaaaagggatgggggaggggatttcagttgattaagaagtgctcatgtccttgactaatggtacccctacatttatgaacagagaaaactgggattctaatccagcctgtttcttagagacactaaactcttacagagaaccccaggactctaacccagtgtctatttacctggaactctaatccagcttctagagtatatgcagaatcttaagaatcaaaatctagcccaacatgcttaaactgacatttatccaaagcactagattttggagttggtctaaaaacaagatgcccaaatgagcaagctgactggagacaaagtagtagtgcttgctgggagacctgcttgtcgtgtccaagagtctgacagtgtggtttccatttaggtcccagtcacagcaccaaaaaaactgtcaaaacagaaccagagccagacactagttaagccagtgtgctctgagagaccaaaataaactcctctttttcaactaagacagaccctaaggttaaggaaaaaaagttacctatgggtccagggttcagggcctggctggcatggcaaatttccaaattcctacaagaaaaagcacactcttacttaacaacagaaattatcaggaaaattatgataactgtaattaacaactcagaccactataactctgactggacagaggaccagccttaaaaacattcttttctgacgagctgttgaagactttttgccagtttcagccactttatagaggatgggcacaaactgtcttgtgtcctgtaatttaaattttgacataaaaagccaaattctacctcattttaatgccgaaacctcatcccaaagtgaacatgggatgtatgttacatacatgtttagccaacctgcatgtgcttggctcccctcataaatagtatagctttccccccaaaacctactgaatatgtgagataccagccctgtgaggtatacgacccaatccgtccttcccttctttgaagagagagtgcctttggtctctctctgtgctagagactttctcttcccagcttgcagaccagtattactaataaagctctcctttctactatttagccatcctggtggctttttggatgacatcagtaaaaaaagattttattcagaaactattgcaagagatggtggggagtggtggctcacaactgtaatcccagcactttgggaggctaaggtgggcagatcagttgaggcccaggggtcgagaccagccaggccaacatggcaaaactccatctctactaaaagtacaaaaattagccaggtgtggtggcacatgcttgtaatcccagctactcaggtggctgaggt

SEQ ID NO: 1696 - DNA, 1350 bp, artificial
  synthetic oligo
gagtagactctatagctctgtgctttgagctcaaagcatgctctgatgtaggggaccaccttcccctacccttggccttttaaaatcctactcaacattccaggccttgcaggaacggtggctcatgcctgtaatcccaacactttgggaggccgaggcgggtggatcatttgaggtcaggagtttgaaaccagcctggccaacatggtgaaaccccatctctactaaaaatacaaaacttagcgggtgtggtggcgcacgactgtaatcccagctactcgggaggctgaggcagaagaatcgcttgaaccagggatcggaggttgcagtgagccgagatggcgccactgtactccagcctgggctacagagcgagactgtctcaaaaagaaaaaaaaaattccaggcccatcttgaacaccacctcttccagaagcccactgtgatagtgcagtcagatcctgccttccctcctctgtctcctcccagggagcctcaaatcctagactcttttggtgaaacacagggagcatgaagcttctcgttatatggagacctgccttgaattctagcttgtccttgacttggcccatgatcttaggctaataaatgccttgacctcgttgagcctcagttttcgtgcaaaaaagcaggtaataataaaccttagggcaataagggacgtgctctgttcgggcaatgccttccctgctgagtggcgtggccctgtgatttttgaatttggctgattcctctcatatggcagcgcaagcccctcaggacgtctatatccttccacccagctccgccagccctcaggtgcttaatgactgtatttacaggcatctagcgcagccacgcagccccggagctgcatcacctctggctatgcagtctttcacttatcaggagggttaatgagatgcagggtagaaaggtcttgccactcgcccgcccgctcgtggaagccgagtagcttggtaacgacaccacgacttcacgtttagtgcattagacgcgtagacccttaggggaggcagagcttcccggtatcgccgagcgggccctgagggctgaggctgggcacccctgcgcacccctgctgagtgcccggccaccagaaagacagatcccccacctttccttctccctgacccggcgcgcttcctggggaacaaactctcccttaccctcagtggggctggggcctcagtctgcgacatacagtgggactcccatgtctgcatgcctgaggtgggcggaagggggcggtgggtgctgggaagacatccgtccgcttgcagctccgctgagtctccagcacctgaaaagccgcggccgaggcctgag

SEQ ID NO: 1697 - DNA, 1200 bp, artificial
  synthetic oligo
gcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgagggga

SEQ ID NO: 1698 - DNA, 1750 bp, artificial
  synthetic oligo
cccagcaatgcagaattgtaagccaattaaagctcttttctttataagttacccagtctctggtatttctttctttctttctttctttctttttttttaataaccttgcccaactggcttgttttattggagaaggggacgcggaataaacaacgtgagacagctgggacctgaggctgggaagaaccccctcccctccctatacatgcccactgccccaaataaaaaataaccaactatgggagagcaactgagacagccactgggggcagggaaaggagacactgaactcaagggcagctgtgaagagaccatgtatgtgctgagagggcccagaggcagcggcagcacgaacagcgcaggtacaaatctccgtgttttccctgggcttacgtataaatacagagaggtgaggccttctctccccctgctctcccttccgctccgtgctgcttgccgcggtccccgctcctctttccgcatgagggcgaagggaagcggggatggacaagtcattgtcgaattgcaatcagacccacatccatcagcttctggatcttctttgcgattacaggattctttaagtgttcgctgagtgcctggggggtccttctgcatctgctccaggataaggtgcatggctatgtcactcatgatctgctgcacctcggggtcggccatggctcgtcgcttcacatcttcggggctgtggtgccggttgtactgcgccatcatacagcgctggtagccgtctgccgcctccttacagctggagtccgggtctagcgccttccggtacacatccatgactttggtgtagtccttcatcgcttccagggcaacggctttccgtgtataacccttgatgaaggtcggttctagctggatacattcttcacagtccttgagtgccagctggaatccaggagtttggtgtaacaggcagctcgattgctgtataatttggcatctttcgggttccttttgatggcttccgtataatgcttcatggcgtggggatagtcccctttctgaaaacactcgttgcctttgttcttctcttctaaagccaggtcggggtttatgtaggccagccgttcttgctccttcaggattttctctgcctgctggcatttcttgagcacatctggagttcggtgctctgccagagacttgttatagaaatggatggcatccttgtacttttcttctttgaagtaggagttgccaattcgagcacacactttggcaatctgtagatagtcttctctgttttctctccccacttcaatggacttctcacaaagctcccaacacttattgtagtcgcccttttcaaagtataccgctgcttgattggtaatgtaagtcatgttgctggggtccagctccttggctttgtcgtaatgcttcaaggctgtcagtctttcttcttgtaggcatcgttcctcagctctttttctttcagtgcctgcttcttattctctggaagatcttcttccactggctctggcttggtctcctttttgggaaggggtggtggtgaaggtgttgcaacctgttcctcctcatccatactgccccgatcgacctcaaggaggacactgagagtggtcaggatccggggatctcgtagttttgtgcccagatcagaaggcttgttttatagttgctctatcagctcccggtaggtaggatcactgagcagtgtccttgtcctgggatcactctccaacttctgttacagatt

SEQ ID NO: 1699 - DNA, 1150 bp, artificial
  synthetic oligo
actcctgacctcaacagatctgccctccttggcctcccaaagtgctgggactaccacccactgtgcccagtttccaagttcctctttcagggtgacaacataaaaatttagttctgtagtccggtagaagataactcttatcacagcaagaggaaagtgcatattctttaccttggtaatcacaaccttctgctgggagcggtaaaaccggaggatcctttcacagatataaagaatgaccggtgcaaggatccacttccaagactgcacagagacagggttaagaatgagattacacactaatttcttgtttaggacttatttgtgtagcagttcatccttcattctttactgagttctccaatgtgtatcatttttaagctactaatttcaccaaatctggaagatggaaatagaaaaaataaaggacaatggtttcgtttgctaatctgttattcataaaacagaccatttcctgaaaatttacaagtctgaccaagaagcaggagaaaagcacagaaatggaacacatggtaaatattcttattcttaaattacatataaaatttaattttaaggcctggcacagtggctcatcctagcactttaggaggccgaggcgggcagactgcctgatctcaggagttggagacctagcctgggcaacatagcgaaaccctgtctctactaaaaatacaaaaaattagctgcgcgtggtggtgcatgcttgtaattccagccacatgggatgctgaggcataagaatcgcttgaacccaggaggcagcagaggttgcagtgagctgagatcacaccactgcactccagcctgggcaacagagcaagacactgtctccaaaaaaataaaataagatttaattttaagaatctaagactgtcttcgaggacagcttgtccaatctaaaaaaccaacagagaaagtagatgtgaaatagaggcagatgattaaaaacaaaacaaacacaaaaaagggaaagtatgtgactgatgctactggtacataaaactcagtacttatccatcacctcctttctcaagtgcttaaacatttaacatagtaatatcttttttaccttgtctacattttttttaaaggcagctttttggccaggcgcagtggctcacgcctg

SEQ ID NO: 1700 - DNA, 1650 bp, artificial
  synthetic oligo
attatctatgaagcacaaaattgatttttccttatatcgtaaacccaggaacatgtgatgttagtttaataagccaggacaagatctgcctagtatctataatggctaagaatgtcaggcaatgtggtgaacaaaagctgccctactgttttccatttctggcttttccacatgacctgtgttttctccctctgctgactcacaccctgactgtttttggtacagacagcctgttccacttctgagtaaatttcctctgctcatctcagagatcctgcatttccacattggttcccactacttgcttatttgaatcacagagatttcttaaagctaaaattggcaagtgaattgaaaatataggactataatttcacagttccatattctgtggtggctatctgtataggatgaattctttttagagaaaacattttttcctcgttgcagcacatttaaatatgccaatgtatgttcatttctctagatctccactcactggtgttataattgaactcctgctgtcattaatgcataattgactatggatttaaacttcttcctctgctgcttatctgctctacttcatagcgaatcaaattgttatctgtattttcccaaggtgagcagagcatgaatttaagaaataacctgtggaatgtttcaataaattatggcatatcaatgcaatgaattgttattctcttaaaaggctgagagctctatgcagtgatgcagtgatggtaaatgttttaatgactagctttttgggaggaaggggattcctgatttccagcatttgccaattttgatgatgtaaatactcccaccatgccagatttcaagacactaacttgatgtcattgaacaccactgaatgcagagttgggaagagatgcacgcaactggcattgcaacctggtatgagctggtttcagcacaccactggttaggcactcacatggaaagatatctgaggctgggagcagtggcttacgcctgtaatcctagcactttgggagaccaaagcgggtggatcacttgaggtcaggagtttgagatcagcctggccaacatggtgaaaccccgtctctactaaaaatacaaaaaattagccagccatgaaagttcgcacatgtaacccctgctacttgggagactgaggcaggaaaatcgcttgatcccaggaggtggaggttgcagtgagcagagattgcgccactgcactccaggctgggcgacagagtgagactccatctcaaaaaaaaaaaaaagaaagaaagatatctgagatatattaacataagcaatttccagccaatatctacaaagtgatcccttttttggttaaaacaaaaagctgtgtgtcttattatatgtgtttacccaaactcatagaactgtataccaaaaaacagcaaattttactatatgaaaatgaaaaagtgaataaacgatagtacccacctcaaaaacaaaacctgcgtgtctgatacatttgtgagcttatgtcagtgtgtgtgtccctgtgtgtgtgtgtgtgtgtgtgtgtgtgtgtgtatctctggggagtaggatgggagggagattttcacattttacttatacacttctattcgcttggtgcaaaagtaattgcggtttttgcaa

SEQ ID NO: 1701 - DNA, 1500 bp, artificial
  synthetic oligo
ttgaatctgcctctaagtcttcatgtaatcttgggtttctctggaatctctaagatctcttctagctctaacatcctgtgactccctatttaagcatggcaaattgattctacacacagcactgtggttatacagccacttgaagaggtcaatcaccaaagtgtcctaaccaatttctcctaaagatatactctcacatgtgaaatatgtataatcatgttgataatcaccaaagatgagatgcaatgcaaatatccatcaataaagaactgctaaaatacattctggtacatctgcagtaattatgaaatacttagattccacatagtgctgccctatagccataaagaagctctgtatgtgctgatatgaaacagtctccagtatatattaaaggaaaaaagcaaggtgcaggatatcatttatggtatgctacaatttgtataaaacttaaggatataaagaaaaaatataaggttatacatatacatacatgtatagcagatctctgaaaggatacacaagaaactggtagctgattgcctccagggaagtgaaatggacaactagggagatggcagggaatatatgtattaatcttgtcaaaacattaaaaaaagaatcttaaccaactgtgccatagacctctctttttcaactatctaacagaacctaagagatcaaagttaggagtgactttgtttcttaaagcagaaagaagattttgaggcaatgttttggctcagcctggctcagaagtgtgtaggtagctatcgtgggtcttagctgtttccttccctccccgcccttgacttgcaggtgcatcttgagagttgcttcaggcagctgacaatgcaaaggaaactggagaggctagaagcctctgtgtcagtgaggcctggaagaagagtgaagcagcaaccggaagttcacgtattcccaagtaaggcacctgaagagactttctcaccccttcagaaacctgttgccacacctccagggtaagtcatgggatcagctgacaccaggccacatgcccagataacaaatcaaattttatttccactatcagtccccctgaagagcaaaagagtgtccattcttttcttcagaaataaatatcacaaatagcatccactgaaagctagtagcaatctaaaaaggacaaagtttaaaaagatatatcattcatagccaagaactaatcacagattaacacaatcagtgggaaaaacaattcatcctgtttagacttattttatgaaggataatcatatataaaattaactgaagcactatgctttgaaatacaactcattcagcaaaaagcctagcactcagttttaacataccaaatgggcacatttaacatgtttttgtgtgtgtgaaaggtaattgactggttttaactattatacaaattgtaataaactaaggggctctttagtttaaataatattaataccaacatttattgagtgcttactatgtgccaagtac

SEQ ID NO: 1702 - DNA, 1850 bp, artificial
  synthetic oligo
aatgtataagaagttcccggaggagatacagagaaaatggcctgaggtcatgggaagaggcgttgaccttagggaggtaataagtgatttcattttgtctggagacggtaggagggaaagactggaagacattctgagatagagaagtttgcagggataacatccaccttttcagtaaagcaagagaatggaagttatttgctgaggtaggtggccggggttgagtggctggtagacatgaacagaagtagttgttttggtaaacatggtcagggaccagcaaataaggctgcggaatggcaaaacagcaatgagagaataagctataccacctctctcacccacaaaggacaaaaatacagtttatttctcctttagcaatgcagcaagtaggcagactaggaagaatcaatacaaggaaaggccagtatgaagaagatccatttggggacgaggcccactcttccaatataaaaccgagttgtccgttttttccaccctcactaccaactgctctacctcaggcccttatcagatgagtactgcaactgcttcctaccaggcacccaggcttccagcctttcccccctcagattcatccttcgtttcacttatcactctattgtatttgtttttaattaactgtctcacccattaggctatgagcaacttgaaggcagtcttccagtcttctctgtgcccctggggtctagcacagaatgtggaatgtagtagacactcagtaatggttctttgaacgaaaaccactggagcgatatttctaaaacataaacctgatcatgccacttgcctgcttcaacattttaaatgatccttagcatggtactccagtgcccccatgggctgatcccatgtgcttccatagcttcatctcctgccaccttctcccctttcccacccatatccccgtcttaagttaaccatacttaactaggacatgcagttcctcagcaggctgtgtgctctaacctttgtgcttttatacatgctttctccctatctgaaataccctagcaaagtcctgtgcagtgataccagggtgagccttgaacatccttctgccagttaccaaggtgaaactaaagtcaaagcttgtggcccgacctacttttatctttctttggcctcctccgaaaatagttgagcctagcctatgttcttgttgggcatgtggtagtctggtgccgagggtgagtagtgagtcaggttcccatgtgttttgtatatgtccgtcacagttgttctgtgtgtgccttcccaaactatttctcacaatgttccctctggtctttcttctagccagctctccgctccaactcattccaagtcagttgtaaaggactctgaggtccctggttctggatggatggtattgacaaaccctgtaagcttccacggctaggatggagggcgagacagggtcaggcctgggctaggctaggtagctgagaaatgttctgttgcggatatgtaggttgagaagccggatgtgttttcaaaagccccttcagaaatcaaaggccttttctgcacctgcatgggggcctgcctattgctatttggaccagataggaagggctacttacacagctctgaaagcttgatgacaggggcaattggttcctatgtcgcttattttgaagaggagatcaggccatatttctagccttttgctgaagctagcaacttaagtttttaaaatttcacctcaaaagaaaagatatatatacacactattttctagctgaaggttttcaataatagtaatgatcatcatgatgaccacagttattaatgatgtattatatgtatcaaaattgctaaaataa

SEQ ID NO: 1703 - DNA, 1450 bp, artificial
  synthetic oligo
ggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcct

SEQ ID NO: 1704 - DNA, 1200 bp, artificial
  synthetic oligo
ctgcactccagcctgggcgacagagcaagactccatctcaaaaaaaaaaaaaaaaaaagagggaaggacgaaaccatcctttttttctgggtttttttttttttggattggcctatgaatttatggaaaatgatctgatacccagtcaatacctgccctatctgaaactcctgctttgcctttactaaagtacctgacgaggtatgaccctgcttgtggctgctcattcccgaggatatcaaaaatcctgggatggagccttgactttctatttccttggttccatcttcagcaatgacttcccaacctgaaaggagtgggtagtcaaggaaaacacagaaggaaacaaaaaggcacagctgaaagggaaggggctctttggctaacagtgctatttaatttagtccaactttaggccatttgtattggaattcctagtttggagaagtgcctcatattgaattacacaataaataattttctattacatgaatttactgttcctagctagaacatttcaaagaatcttaagttccacacatcaagactggcacacaaacaccagaggtgaggcttcgtcagcatgtacaaatggggcagaacagactatgcagaaaatatttgtataaaggatacgggtacttacggcttcagcatccgaacgcagcagtctctttacttcattttccacgtctggagattcaatgtactgaagcaaagttggggattagagggggataccaatactgtcatttaacaccctgtgtgttgcaggagtgccctcctacgtaccaacgaattcaaatgttaggcctctttaaattctgatccaaccaaatttctactttaagtagtgctatttataaaggaatctttagccagggtctagaattttgtacagtaaacttacttttttcctaattaaacaaattacttgagacatttaatcttttcaatctgcagctctatggtaaagccctctctcagaggtgcaacccttaggtctcagttataaattatttctcctgatttatattggcaaagaactataattccttattagttatttagaaataatttggtttaaagatccaaattcccagatttcacttccccacatctttattattagagacgttcctataaaaactggatcttagctgcatgttctcccttgaatccagttttacataattatct

SEQ ID NO: 1705 - DNA, 3100 bp, artificial
  synthetic oligo
cttggtcttctgattgcttttatcacttttttttctgtaaaacaaaacaaaactcagaaatgttacagaatcagagtattaaaaaatgtacaagtgtatatgcttcccagacacacatggatacatttttcctccacattttcatgatggcagtattaagtagtgagtatgaatgacacagcatgaaactggttactgaatcagctatgagctcagatggcctcaacatacatactcaagaaatgttgcatgtttaaataactgagagtgtgctaaatctcatctaataaaaggaggagaggggctggggaactcagaacacagtcatgtaaatctaagggttgggcctgaacgatgattactttgcacacgtgccttctaggtgctgaatgtgtgttccagtagcattgacgttgacctccttgcggattcagccacaggtttctgacaagcttgaggaagcaatggtaattttagctttttcggttttgtcttcagataatgaaaagcttttgtaaaacagctgagtgtcaatatgagttatatggcttcaatctcctttaaaaataaaattcttaagggtccaaaacaaagaagagggggcaaattaaaaaaaaaaaggaaaaaaaaaggaaaccaaaccaaaaacaaaacaagaaaaaagaaaaaaaaatgctgatattgccacaaatcattagaaatctcctgacatgctgaaaccaaatggccttaagttcaaaacaaaacagtgacttgtttttaatttttttgtgatttcgttttgctcttcctgcccctttgccgtccgattggtgatgttattcaaacaggatcggatctctgctaagtgcaggagcgaccccgccgcttctttaatctcctcttcttcgccctggtggggggcggtgcgggggcggtgctttacagtgcgtctctttttgaggggcagtgtgtcgctggggaccttcctggccttagcaaagtcctggcgtttcttgtgctgggatgcgtacccgctgtcccccagagcatccctgggctccttctggctgtgtttcctgtcgtcctcttccctgtcgctgtggctctcgtggctccggaagctcccctcgctgccctcattgccctcctggctctccttgctggcaaacttgtagtggtcgtcggccaaggaggaggaggggatggagtcgctggtgggcaaggtgctccgggcgttggaggatttggcattggtgcagttgtgatcctccttagggtctccgctaaccaccggggagccacacgatggctcgctctcagtccgcatccggcagctggtgatgccgtacatcatggcagccgtcatctcaatgggactgatcggcagctgccgcacaccaggaaacagtcctctcagctcaggacccgcgctccgttttgtatcactcctggaggaaaacctgcttgtatttcagggggagtcccatggccctggtagcatcaatgtcaggatcttggagaagggctccatttctcttgaagaaggtactgcccggccagacgggtagacctgatgtgctttgatatgcctgaggacaggtgggaggtgtattgaacacgtgtggatgtgggtgtgggagataaagtgtctttttcaaagcctgagttagattttgtctatactctgggtctatgcaccacaacgaccctttcccaatactctgactcctctcttcgtccactttcttaaaatccttattcaatgacaaattgtgtctcactgagtatttccacccagtaggtgcatttgcaaaatatggaaaatgtttcaagatccagttgtaaatatctttcacaggcaggcgcttggttggagagtcctcgatggccataaatatgaggcagctaaaggagtaaggggggattgcagttggggttctgcctggcatcctagggcatatcagagtgggtggggacggtggctgtcatcgtccaggccctggaccgggctgacactcgaggatcgactccccaaagctcttcagcaagttcttgctctcatgcagccagctcaggttggtcagctcttcatcttccatggtctcctctttcaataggatgtcaggcagagaaaagtcgaggtcatcatcttcctaaagggcttggagaaaccactgccccagtaacactgactcagtccactggagacactaactcctgagctttctggcatcttactgggaggcatggcgggacccatatacatgaaggctcctgagtcagaatgggtccaggaaaccgaggtccgcattgcttccgtcacagaaggacagaagggcctccataatcacgagaatgctagtcttctaggggcttctatcacctggccccgcgttgcttctcacggccgcattccggggatgcggcgacgctggactcacctgtggcccagccgctgggtcgctcagtctcccagccgagctgctgccggaaccccggctcctgtgcccggcgcccgcccgggccagaagttaggtttcgaattcactaaaggtttaggattaatagttcgtgaaactgttttacacatttcagggtgactccaaaattcttcatcaatattagactcatgctgcttatgaaaatgcaaaacaaatgcagtttttctacaagatcattataagcttatgtatttgccttatacatacttttgtaatttccactgagagtagaaatcatcaaatcttactcatctttgcatctctcactaagcattatagcctaacacagagaggtgcccattaaatgtctgttaacaaaacaacagacatcaaaggaaagctttagatctggaataactaaaaatattctgacattatttggtatatgttaaatagttcataataaattttattataatttaaatagtgcataataacattttaaaaatccatgcaacaagaatctctcatatgatgaattcctagaaatgatgctgcaagttcagaggtctgtaaattgtgtaaaatgtaagtggtgaatatttttcaaacaaatgtatattgtgaaattcaaatattataaactatttaatttacaaaacaaaatacaaagaaga

SEQ ID NO: 1706 - DNA, 1550 bp, artificial
  synthetic oligo
gaagtctgtgaggaaggcatctttatttccagtttacagatgaccaattcagactcactgatggaaaatcaactttgccgaggcctctagtaatgatgaggactggggatgtaactcttactctcctcaaaggacaaaacatggtctccttttatagaggatgaccttctaggacttaaacacctgtagttttttatgttgctaggattgtgcccttatgtgtactcactcaacaacctgtttctctttgaagaagctgatggtgcagatgaaatcccagcataaggtcctgtaagcagtaatgtgtctggtatgagggtcaagggtttgtgactcctgccttttcttaatctgcactctctcttcatttgagactcaatgggaaactgcttttccaatatcaatctagaagatcaaagaagggggcagaaaatgacaaatcttctcacctcaccccaatacctcaacaaaccatcctgcaacacagaaatggccccaaagcttcatgtataatgtaagtgtgagcacatgctccatcttcctactccacttccagatggtttctgtgatagttatgctgcttggtttagataacagtcatcacttctctgggagggagaagaaaggtgggcctggatgaccatttgttgaaatcctactaggtgccatatactctgtgtgggatttctcatttatcaccacagaacagttttctaagaaaggcatcatgagttcccttttacagataagcaagggcaggctgacagaggctgaaaaaggattccagtgtcacacatcaaataagggacagtaatggggttccagcttgtactttcataacattattttatgcattcccaagaggggtgatattaccagtaaggggctgaaaatagatttttgaggatagagggatgatagactttggaatgatttttggtactacaaaggtccatattacataacaagttaacatttcatctgtggtattaaaatttcattatctgggcagaaggtagttgataaggaaaatatgtctaaaaatcctcctaagggaggtggtattgagagaagattgagaaatgttttatatacccagtgacctctcctacagatgattaaccaccaagacttagggactaggcattttatactcccgcatagatgctcaccaaataatcctgttgttgatgacgataatagcgggggaagtgaaatcatccccctaggaccaggagaccttggtttgaggactatgtgaattgactgttttgttgttgttgttgttgttttcagacggagtctcactctgtcgcctagcctggaattcagtggtatgatctcggctcactgcaacctctgccttccaagttcaagagatcctcctgcctcagcctcccaagtagctgggattacaggcgcccaccaccacacccagctaatttttttatttttagtagagacagggtttcactatgttggctaggctggtctcgaactcctgacctcaagtgatccgcccgcctcagcctcccaaagtgctggggtta

SEQ ID NO: 1707 - DNA, 1450 bp, artificial
  synthetic oligo
ctcggcttactgcaacctctgcctcagcagagcaattctctgcctcagccttctgagtagctgggattacgggtacccgccaccacgctcggctaattttttttgtacttttagtagagacagggtttcaccatcttggccaagctggttttgaactcctgacctcgtgatccaaccgcctcagcctcccaaagtgctgggattacaggcgtgagccaccatgcccagtccaatttctttttttcttttctttttttttttcaggcggagcaacttgttttttaaagaaaaggagtacagtacggtttgcagagagtaagaaatgacttggaatgttctgtttactaaaataaaaattctgtttggaaaattcatatgtatattaaagcagttccaatggctgttgacttcaaatctacatcacattcactgatttatctcttccctcctgagtgtaggttgaggtgtccacactgtaggagagcccctccctcccagaaagcatggcattcactctccattaccccacccctgtataggtttcccagaccttctcccatctcctctcagtcatcctctctccaggacacggtggacacagctgcccagacccctcaatgactgccgatcctgtctcagacacctcccgcctgccctctgctgctctgtgctcgcccaccggccacgaccaaggcgcactgctgctacctggtgtttcattatatggttttacaccattattttatacctatccggttttttcagagagtattagaatgttctgtactgagattcataaactgggtcgcaagagaggtattgtaatttttgctccttgcagacactttgaagtttgaaaatagtggtatatagtggtactgtggtgccccctcgtgacataggcctgcactgcagcttgaacatccatgaacaggaagccagacagttttctggtctgggaaaaaagtagacataccctgggtatccaggcaaaaagtgaagcctctttctatgctttgtaggttgaacaaaagagtaatttttatttttatgctttaggacatctggataaataggttgagacccatataaacaaaaatggatccaggctatttgtgaccattgcaacctgcttttgcacctaatatatttccatgtaaatacatttctatgctagcactttaaactactttgcaacaaaatttcactttttttttttacaaggaccaagtgtttgatagtataaagctcttaaattttatttttccagtaccctagcgatggaaatatagtcattttacattttctattacgaacaatagcatacttaatgttcttgttcatatacatgaaaatatcttagtaagcgtttctttataataaagtcttgaaagtgtcctttcaaaaccctggtaaatgataaaattttatattagcataatgaattcaa

SEQ ID NO: 1708 - DNA, 2150 bp, artificial
  synthetic oligo
tccggctccaaaatggagggaggttggagaaaagacacagggaactcaggcctggacccgttgcagggtccgccctcagcagcctggggtcactgactgtgcccgcctcccgctgccttgcagggatcaggccgttttctcgccgtttcgtcgctgttctcttccctggtcctcctcctcctccatcagacatcacccggtcgccggcttcctaggagttcccaactggtacccaattctcaacccttgacctctctcgagttccgcccccctcccccctccccgccccgcaccaagccctccatttcttgcaccaaatgagtgagcatcgggaaaggagtggagagaatccagtcctggacccgctctggtctttgccctctgccatcccaaccacagggatccacaggctgtggatgggttcgtagccatctcggggaaatgactctttctcacatttccttctgccagaagcctgcacttctccagggaaataaaagctggtacccatacctcttgcccaacacaaaaaaatttctgcgccaaaatgaatgggggtggaacagggcggtatctagaaagcagatccgatcctctgtagcctatgtgcattaccatccctacctcaggggtccccggcttgtaccgacctgcagggctgtagggcagttgccttctctgtccttcagtctgaagtctgccttcctccacggaaacagggatctggtacctggaggagagggacttctgcacacgtcggcttcagatcacgtgagaaaaacgtcaccagtgggctcgggtccctagttcccctcccacccgcagaaagtgcgtcaggagccagcccacttcttcccttcactagtctgtccgtctgagcgccctcagcacccccaaccccggcttagctctctctctcgccccacagcacggggccctgtcactcattttggtctttgctaatcccacaggtcaaatgtggccctttctctgtgtagtatgtatttattcttccgtggttatcagggagggaccgcaccttcttctagagctattggccattggtacatctcagaggaattttttttctttctctccttttatccgaaggcacctactcgatctaattctacacgcagccactgatgttcattctgcctgtgaaccagaccttctcataatgggtacaaggtggattgtcaagtagggacacaagtagttaaaataggggttttatttttttaaatttttttgatcttatttaattcactctcctcagcatgggttattcttataagcacaaaattaaataaagctatttcatttatgagaaagtgtttaagagagagaaaaacttaaaagatttcaaaattttctactcagaagagagaccaaattaggttcataatattaacttttgccatatacacaaggaattcaattggcaacaagcaaaatatacattagaaatttttcataaatagctggttctctcacgttctatttaacacacacacacacacacacacacacacacacacacacacacacacacatttaatgttcccaaacgattactgagtgctaaatagacttgctggaatctgatggttgaaagaaaattcaaaaatgtctctttaaaaaatttggctcatggctattttcattcaaatgtttagctctaggggaagggaagagctgtgagaccaaggctgcaggagatgtgaaggatgcagaaatggtcctatcctccctgccctgccaagatcaggggaaggtgttcttctccaccccctcatattctagaatttctcatcccctgcatttctcatccccaggcacatgactctgttgctcaagagtcatctgtccaagaatataactggacaggtgaccaaggtggtgatatgagtaaatgcctttggctccttccctcctccctccccctaattcccacagggataacccagccccagcacagagtggagcattgttcatgcctctagaaaactagaacagatctcttctagacccttgcagctgagggtgttcatgaggcctgaagtgattgctggggtagagtcccctgcaacctgcctgctctctgcccttattcacagtgcctgagtggaagcctccctagaccctgt

SEQ ID NO: 1709 - DNA, 1500 bp, artificial
  synthetic oligo
ccattactcctaggagacagagagaaaatggactcaattcttggtgaactgatcagcaccgaggacagaggcccgactacccacctttcaaaattcagagccctggatttcaaaggccttttttaaatttcattttttttccaccagagaggccccatgtaccctcgggggggcgaggggagccagtctgtgcccttctctcccgcaaagcccaccatcttctctgcagatccatctccaggcctctgcaggcaccaaaatggaggacgaagaaggggtgggggtgggggattgctaagtgtgggggtgaaggcacggattggggtctcagactgggctttcctcatgttctgaccccctccccaccaccgtccctcgcactgacctgggcctatccttgcagtctcctcctcccgattctcgacgtgaggtgcgtcgccgcaacacttggccccgcaaacctgcagacggccggggtgggaagagtgggggctgctgcagcggaacgctagagaggacccgccgccacccggccccttccccacgccgggcccgggccctcctagccgctctcgccccccgcctcagccgcccagccccccaagctgaccaccattttctgcatcaagaagggcggagcaggggtgttggaaaagcttgcgctggtgacggaggcaggtgcttccgaaaggtcgtagcctcaggatcgccggctcccgcggggccgggcacccctccgctcacacaaggctcgcggtcccgcggcggggccccggggctgcatcgtggaccggctgcgtctccgcgctgctgcccggggatggggcatccgcaggccggggctgctcccccacaccaaccccagggaccccctccgggtcccttacctgctccccctccgcttcctactttcggggccgtacctggcccgcacgtcctcagggacaccgggaacaggtaccactgccgagaagggagcgagcgacggcggttctgacgccacaacgaggtaagactcagtgttggccgatcacgtgtggctgttgtcatcgccagaggctccgcccccgtcccacgccccctcctgcagcccggagtcaggtggtgctttcgggcccgcccccatcctcaccgggagtcccttttaacatccccagcctgggctctgccactcttccttctctgtatattcttgagacttcccctgcttgcccaggaaggacggaaggtatcttctcagggagctgttggccattcccacttctctggggacttgcctctctctgcccttggctcccaggattcacctccttctgcctgtctacctccttctgtcctcctaccaatattctccgttttctctccactaaaatgagtggaagaggtgtatcaggaaaggagcacaagagagtaggcttttctcattcttaataccttttctgtattatttcttttgtaaaacacaaaaaattaatatacttctttaaaaaggaaaaaaag

SEQ ID NO: 1710 - DNA, 1100 bp, artificial
  synthetic oligo
ctggaaatctaagggcaaggtgctgtaggattatggtctcagtgactcacctaatggaaggacctcacatgcccgggagcccctcaaaagagtaggttccaactgacctgtacatcttaaacttcaaaaaatatgtctgcctaaagggtctatatttatattatgacttcagcagcagaaacaggtggctggcctttttatcctcctatctggaatctttttccaaatgtacatatctttatcatatttctgattattaaaagtatataataagtttatggaaaaattggaaaagaataagaaattatcaaaacaaaagtaagaagcacaatccaaatcattacctcctttcctaattcaccccattccctccaatctggtttcaaggattggactccaagggaaatgatggctattagtggctgagaggcgattggatggaggagactgccacttttcttttcttgtagcttagaaaaggataagtaatcctccctctcagcacaaccacaaaaaaagtaacaatggttaatataactttgggaaaatgcagcccctccctggtaatcagagaaaggcaaattctgaccacagggagaaggcgccacttttgacctctggaattagcaaagacaaaaatgagtgacagggcctggtgtggtgtggggtgggaggttggtaagccggtccacttctgcagcgctgctggtgggaggggaaagtggggaccagagatgggggatgacataatcctcacgtgatcaggagctgacgtgaaccgaagtccttatattcccgggcttctttctcctctgggtaccagctccttactgccctgcagacaagcgtgccgtgcgtgcttgtggccaagggaaggaagaggtaaattccttaaatcccagcaggttggagtgaaggaaccactggacccccggggtcagtagtgggtgaatctaatgactggaataggtccagacttgctttcccaaaaccgctgcaaaatcgtcggagataattgtatcttttgcagggggaagcaagggggtaggtcgaaatcttttgagagacacctagagatttagtgacagctttgaaataat

SEQ ID NO: 1711 - DNA, 1350 bp, artificial
  synthetic oligo
aggagggagttttgtgtgtggaaaagatcaaggaaggatggtaaaatcacttgggacatattgcatttgaggtccttcagggacattcaggtggatatatctaatcgttaattaaaacggatctgaatcaaatttatgctgaagttcatgtagaaaaacaaacatacaagaatgtgttggaaaaaagagaatctactgaggggacctagctctaccagatatatgaaattatatatcctctataattcaactggtatatggatagcaaacagaccaatgaaatagaataaaaagcccagaaggttttccaagtacatatggatatttgatatgtaataaaggtggtatctcaaatccctaaagcaaagatggactttctgatgccagaacaactgagaaaccgattggaaaaagaaaacaaaagatccatcaatactttatgccatacacaaatataaactctaaatgtaaagaaaaccatatgaatactagaagaaaacatgggtgaatgcttcttggaccttatgtaggaaaagatttcttaactatgaatcgaaatctagaggcaataaaagttaaataaatttgactactttttttaatgcatggcagaaaaacaccataaacaaagccaaaaagcaactgacaaactggagagaaaattgcaacatatataacagttaatgtattaagaaaacttgaaaattgaggtgagaaggaccaacaacccactagaaaaatgtggaaaagacatgaaccgacaattcacaaagaaagatatttaaattgtccttaaacacagataaggcaaaataaaatgccattgagatattacttctcaactatcatatcagtgaacatttaaaagtatgtcataggttatgttgggaagggcattgggaaacaaaacactcccctatatttctgatgggaatgcaaaaataggtctgagattctggggagggaatagcctggagatgtaaatctggaagtcattggtctttactggaaatgaatgagatcaaacagggagacagaacttgaggactgaggagagaggaggcccaggacagaaccctaggaacactgccactcaaggtggcagctcagcttcctggcaggcagcaccaccctgggctctggagtcaggcagagacagtcttgaaagcgggctctggagttctggggctgagcgctcttggcaaagtcgggtaccctctttgatcagctgtcacacctggcgataatggcatcagagagagataccctgcgaggatgccgtgagatgcgccaggtaaagcacctggggtcagaaagccaccccctcctcctcttctccgtgacccccct

SEQ ID NO: 1712 - DNA, 1550 bp, artificial
  synthetic oligo
aacttttatcaataataattttaaaattgactatgccaaaggaaagattggagtatcttttttttctagaaaatatgttattacaaaaaaaaagaaaatatgttattacaaaaatgtcataagaagaaaagatcaaagaattcgtagccaaaaattgtagggaaaaaaaaaatcactgtagaggtatgccaggcagttaattaagacaatgttatttttctggaaatttttaaaaaatatgtcagctgttcaattttgtaatttgttgtgatttctcataataagtaaatgttgacttttgtacatagttgcttgaaatgctcatactttttaatattctttttcttagagtcctccgaattataaatttcattacccacaacccgaatctgtccctgaggtcataaaaagtaggagcttctgagttggaattgcaaagggttaatagggatgtggatgtggttgagaactgggaaatatagcaattgtggaagttgaattaatatcatttgtaaagaccacaacattatgaccagctactgaaatctgaaaatccaaggtgtcctcagtactacgggattatgggacctcggtgtctgacttcatggaaaagcctcacacaacatagtggcccctcataaggggagcctccagctgctctgtacatttcaaacatccaaaatagtggcgcctagagtatctatatttgtattaccattgagcagcaaaaacagttggctgggttatttacccacatgcatacttgaatctacctcctgcttcccatctgaaaataaatagctcttttctattttctagtgacaaacaggatgtaggctgttagtaataatagtaaagataataactataaggaacagaacatacaaataaatattgaaaagaattggtgaaaacctctctcactctcactcccagtcttgtttcctgagccccatttcagcgtctggacagaactgccagggaactgctagactttagggtcttggcggacgggagttggagaatttagagacaggagaggaaaaaagaagacaggatcgattaactctaaaaggctgatcctccctgataatctgagaaaggcgaataaatactccaggaagatgataccctttcggattgttaggttgggctggggatgggcaacccggcttctgctgaagtgctgttgggaggattaattagggatccgagctcactgttaacacacgggcctcactggacaaagggctgaagtgaattgaagtcagtatgtagtctgagttctctttccatcctgagcaccatctccctattgccttagaggcaggcgggagcgcttcttgctgctaaacagaaaaggagaagactactgttggctgcggatctgaaaaggttcgaatgattaaaggctatctgaaggcgaaggagaagatcatagcgcatgcaagactacattgcctatacccctttccggcccctactccgatttattttaggggaaaaaaaatggtgggcttgggggagggatctgggatggggatggcggt

SEQ ID NO: 1713 - DNA, 1150 bp, artificial
  synthetic oligo
ctcggcggtggggacccggtgtagccgcctcccgccctccatgtggcaagcgctccctggctcgcccactcttctttcatgctcatcgtccaaccctggtctcccttgtcctccttctcctcccctagccgattagtaggcacagcggcaatagaccgtcaaatattgctcttccacttagctcctctgcagcctgggcctaagccctcaagcagggctagccactgccccacttcctgcaattatcctctgatctacctcatttatcctagctcaaaatcctttaattttgccaagagggtagtacatacaccctcttgtttcaaataactcaggaaaacacatgatcacaacacattgctaggccctctaactggctacagcttatgaaattttcaggcaattaaaaaaaatgtccacatctgtagcgcaggcatagaggacacactgccctttactcttaccagatacagttctagagggccacacagggggcattacttgaatttcccggaattgctgctggggcagaatttgatgttttaattgtgcctagccgaccagctagtctctttttgttgttttctgtagccctctggtacttccaactagtttgtgattttccccctggaattgaagaaggacaaagctcctgaggtcatttagcctgcactccacctctctgtcaggcagctccatctctgaagcttccccattgcccgaaaccctgtgaccttgtggcacaggccctcactcatctcatgaccccgtccaggccctcacacatacccgctacttccatctaggccactcttcctctgtctcttgacaaggcaatcgtgcaatcaatctccgcaggccccagcttaaatgtcacttctcaggataacctttctcgataatctcagaatagagatggtgccccagtttatactcttgtagcctcctgtaacttgctgtatttttccttcataacacttacccatttttggtggtacatttaagtgtatgattatttggttgacagctgtcttccctactaaactatagtggggaaggactatgaggtcaaggacaacgtttgtgttcaccaccgtatgcacagagcctagggcaatgcttgctgcataggacatgctcagaaaatatt

SEQ ID NO: 1714 - DNA, 1500 bp, artificial
  synthetic oligo
ttttactcatattttcctttttcactctcatgctctctcgcgtgtatggtgggattttcccgactttcattgtgtgtgatgtggcaacagatcacgtccagaagcagttacaagaatccagctgacttttcctaggtgagaagtctgggggattttcaattatctaaaagaaagttgatcaccactctacggctttagaaaaaatatttttcatatgcgtttgtaatttatgttaacacgatgtgataggtttttttttgttgttgttttttgtttgtttgtttgtttgtttgttttgagacggagtctcgccctgttgcccaggctggagtgctgtggcgcgatctcggctcactgcaacctccacctcccgggttcacgccattctcctgccccagcctcccgagtagctggaactacaggcgcccaccacaacgcccggcaagtttttcgtgtttttagtagagacggggtttcactgtgttagccaggatggtctcgatctcctcacctcgtgatccacctgcttcggcctcccaaagtgctgggattacaggcgtgagccaccgcgcccggcggtgatagatttttaagtattactttaaagtggattttaaaataaattcatcaaaatttctgttataataattttgaagtaaatatcggcagatataacttacagaaaagattttggggttcctactagtttttagaagtgtaaagttgtcttgagaaaaactgttctagctatttaatcatttgcaagagaatcagatcaattgaaaacactgagcccccgttttagtggttaagcctttttaaaagtccaatgcccaatattcatcaagactttgaaatcataccgctgatagaaagcttttttgtcaccttcctgactcccatatgaatgacagtagcatttcatcctcaaacatggtgttgggcttttgtttgaggtcagtagcatcttttcttttctaggcattttaggtaaagtaagagataccaaatattcacacatgccattttagcaacctttgagatttacattttttaaaaaaatttcttggtttattcatataaatcatgtttatagattttctaatattaaatcatactagctttctgggaaagaaattccttcctgtgggtggcttccctggatattaattaggttccttcctatgcctcatcatgatgaaattcttgaccgtgcacaatcacccagtggttaagctcgggtttctcatgactttcacacccttggccacttgcttccttcaaaagccccaaggccccgctgtgtcctgggggacttcaggttcgcagaagcagcctggatcctaggctcagctgggctccctctgcagcaagaacctgggctgtggtgtgggacaaaacaggggctagggaagtgcgttggaccccttgaagagcctttccttcacctgtttttgtctgagtctccagctctccacaccgctcacatttcaggcacag

SEQ ID NO: 1715 - DNA, 2300 bp, artificial
  synthetic oligo
tcggaaaaagaatgcatgaaaaatcttcaggacgccacaggccacctgcccctcccctttactacctccccccgcaagaggtaataagaacccattaatctcatgacctcaggtctcaatcacacacccctttgtcaaagtttacccccgttatttctcagattcttacatgagctcggaaactagcgttcccctgtattttacttgcagcctctcaacaggtgcctgccttgagaaaattagcctctggggtagagtcgacttttgtccactgggggtcgcagatcccagtcctcagggcctcaagactgtgccgcgaaggaaggaaaggaagggttgggagcagcctcttctgaaaacctgatacctcccctccaccgcctcctctgtcgccaggcggaaaattccctctcccatcttctgaacacaagccaaagtgcctcctgcactcccgccccccgtacatttcctgcgggaaaccgtcggcctaccagctctgcaatcagccgcacagaattcaaattcggattcggctttgatgacctgccagagagaaagggactagaagttggatgacctcccacccccatattccttcccaggaagagatgaggagatgcaaaaggggttcaagacagcttgcgatcgtcttctcccgccccttgccacctccccgaacacccgcccccgacgcccgacaacacccccgcccacttcaatccaggcaaatcataaatcctacccagtcggcagcatccagatgagccacaactcctttctcagcgcaaccaggccatgggagtgctccatcccctgcctcgcagttactgattctccaagccgggcgccgcccagtcctggtggggcttcccccacccctctccgcgccgggaaatcgcgcgctctttctttacctgcgctccactggtgggcagcgtatgctcccgcgtcgacagctctgtttcgccttccggtccccatagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctgtgagtttgctgctaccccgtcgcttcccttctccccatccccttccgcctcggctctgctccgggctttgagaccggatgcctgaaacacgaggtgggacagaaaccaagtgaacaatgagagttccttacctttgtatagggggaaggggggaaacagcatttactgagtgctttctgtgtgcggatgcgcctgtctcctttcttctcagcagccctgtgaaggaggtagtagtgtgcccacttaacaggaaaggactgaaacacccaggcggtacagttaggaagtgcagagctaagagctcactcccaagtcaacatatctgacttcaaaggctaccccttgccaacactcctctattctgttagattaagggatagcggagaaaaaccaaagccaggatgggaggaccaacttgggactgcatagaattagtgagcaagaactgttatctccatttcacagatgaagaaactgagccaaagacagagaggttaagcgtcttgcactgtatcccgcagcaaagaagttacagcatccaacttagcacctgtatgttgctctctagatgctaattgtttgccctgcagcattgtctgaagagcacttttgcacaggtagtctcaaaccatctcaacagcagtctcaatgtgatgatagtgctgagggagggggtgaggaggtagtagggagagggctgagggaagatgaaggcaacctttatggtgcccattgtacagaagaggaaactcttcttggcactcttctttccttcgtttttttaaaaatacttttttttatactacaaaaagctgccctttttataaaagcaacataatttcgacagccctttgtgacgccaagggaggcaaggctcagagaggtaaaatgatttgtctgaaattacaaggtgaagccaaaatt

SEQ ID NO: 1716 - DNA, 2450 bp, artificial
  synthetic oligo
ttgaaagccagaaaatctaattatgctatagccaaactacctaatgctttctttatccacaagtaactttgcttcaatttcttgatgttgggtttcatctcactgactttgggcttctaagacacatgggaatacttatatcgtcttggattctttgggtcaaatcaaacagtagagctaaagttattcaaatacattcagattacacagatcccttatgaattactagtatcatagtaggaagaaaaagatacaagaagaaaaatacatcctagaactcattatcaaaattattggtgtatagtctgttctagcatagattagctttctcaacctgctatataaaattaccagcaagaaaaaaaggtgcaagaataagatttatggctgaagtggcttggtgtcttgattctctattctagcattctcagaaggatcccatccgttagacacgcagaaactgcagggacatttgaatggtcttgattccttcttaactcccttaggctcctcgtttgttggtcttctttcatgcatacgaactctgccgagtaacatgtatctcgatcttgccatcttttctctctgcacagacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagtcctgggtctgatcctagttagctgtcccttcttacagcgtttacaaaccagtgccacaaggagctattatgagacgtgtattgtagtgccttaatgtactgtcgtctttggggatttaaaatagatagaaattaatacaacttatctcattctttttttgtgtgctgctccccatctcccaagaaaaatggcaaaaccaaaagtaaatagaaagtgaagatgctcaaatggtgctatgttctgtttcaaaataattacctggttaaaaccagtctttattttttcttctatccctgtctg

SEQ ID NO: 1717 - DNA, 2450 bp, artificial
  synthetic oligo
ttcggatggccgtgtgcctgctgctgccggggaagatgggcaagctcgctgagtctcagggcacgaatgccaccctcaggtacaccaaaagcaagtgagctatctcaggagcgcccgagcacccgggaaagccaaatgctctgttcagaaccaccacacgtggccctaaagaccagtggcctgccaaggaggggaccccactggagattggggtgggtggcaccgttctggcttggggagcatgtggcgtgtggccttctgcggtttttcaagcatttttcccacagtgcaaaacactcaactccaatacatctgtagtgcaatatgctccaaggaaaagtagggggtgtttccgtaatcgtgtttcatgtcctcagtttcctaaatggccgtttttatcagttatctttctaggttatctttgtggtgatattatcaatgtactgatgtttacccttttcactctcattctcctacaactggatggtggaattttccagaacttcattatgtgcgatatggcaagagagaaagtgaatacgctgatataagaagcaaggtaaccctgctaaaagtgttcagcatctttctccccatgaatccatgtaaataagcaaacaaggcacagttacagtgtacatatagctaaataaattttcaagaatccattcgttttccagcttccctgactctgagatcactattgcaattcattctctttttgcactgacaataatcatttcgtttctttttgaacagaaaccttccttccttccagttgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaaggcatggcgatgtgattctttacctgatgtttttgtttgcagtgtttgtaatcatggtcttttagggatatgaatccaaagctaagattaatatacgttccttgaccctaacatcaagttatacagagcattgtcagccattagaagaagtcagataacgcttatttcctcaaaagattggcatattaatattcacgttaatattaatacaggctacctttcattgtgctctcttctgggtcccaagtcttggtatttttagaattttttttttttctataagtgtattgctgaatttcagagcaggtgctgacttacccattgctttccttttccattgatttccagtcgcccgagtatgtggacaagagaacatactctgggattgcaacccacaggaatttattatgttgtgccttgaagctcaatatgtggccatttttgttaaatgtttcccgtaaattttgaaacatctcataaacaacccttctccttcatatgtagaaaccagtaaaggatggcactctcagtcaaaccacgaagcaaaagctggataaatgacaaaaatcaaaattttcttgagcccgtcagaagtgggaaagaaccaccccagagggacccaacacatagccacatagattatttcaccatttaaagaggaccccttggtcaagagggaaaagggttcggggcaggatagtagccagagcttccctgagtagtgcagatgggaagaggggaaggtcacctccagagctccacttgggatccatagagaaatgatatagaaccaagaagtccactcactgggatttgttactttctgtttttccagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttatttctcattatgctaattgttttgctgtaaagtgccaatgtttctgtgaattaagacatacgaataaatttctgaagttacccttgcatatgtgtgtaattagacaagtccttttgagaaaccagatccattgggatattttaccctggaatatgtgttttccctttgtaaattcagaaatcaaagaggaggattagtaaaacagggttaacaatgaaatctgatttgtttgtggggagtgaagaatgaggtggcaaggggactgatgttggtgaattataggaagaaagaggaagggggtggattgatgcgaagatcggaagaggaagctcgcacatttgatatagcatttcagtgagtgattgagcagaagggaaatgtagcgagcaatcatgatgtcatg

SEQ ID NO: 1718 - DNA, 1050 bp, artificial
  synthetic oligo
tgcagctagttcggtgtctgcccaaatgaccgcccagttttgtgtttgaaacccagggccctggtggggtaggcaccgggggaaactcctggtgtgtgggttgcaaaaaccgtgggaaaagcacggtatctgggccagagtccatggttcttcaggctcagtccctcacagcttcccctgggtaggggagaaaattcccaaaccccttgcacttcccgggtgaggtggtgccccaccctgcttcggcttgccctctgtgggctgcacccactttccaaccagtcccaatgatatgaacagggtacctcagttggaaatgcagaaattgccgccttctatgtcgatcttcctgggcgctgcagactgcagctgttcctattcagtcatcacgccagcaaatcaacatgtgtgtgtatcataagtattaacatatattgagttgatttttcactatcgagctctttaaaaatcctttgaaatttcttctcattagattttaaccagggcaaacagctgatatttctggcttttgacctttgttgtttgctttgttatctgtaaaataaagttatcttttcagttaagtttatccaagattgtgacttaagcaatgatgcagaaggtgtctccaaagaggggaaattagtttcacaagatccagaactgacccaaaccccagagacagctcaaagagaaaaggaagttttgctaggcattaacaggatacagcccacatgtttgtctcatcaaattttctagggtcttagattctcagctatctacacacaataaccaaagggactcatgtgcccttgtcacagatggaaaaagacaggaaatcaaaagcaatccaacgaagggaaaaagatcaatatgaaataggtacttccccaaagtcacacaaatattaaaccgagaggggctggtttcctgtccaggaatgcaaaccatggcatcgaggtgaaagcacagaatttgaattaaaaggccacaaggtggagacgcctttgttgttatgctcacaggggcagtttgagcagacacaggagt

SEQ ID NO: 1719 - DNA, 1050 bp, artificial
  synthetic oligo
ggggtggccacacgtacaggttttgcctattgtcccacccaatgattcgtagtgccccattcactctgaaagctgcccccacatttattagacaagaacttatgtgctcacttgcctatgaaaaaggcaaagaagcctcacacatcaggtctttggcaaccctgacacacaacgctgagcgaggatccgcagctctcccaagagagagtgggctcctgaaggaagaaataaggaataaccagatgacgaatatgatttagagaggattcctagtacaacgcagcttgtttggaactggagaggtcgcagaacaggagtggaagaatgcgtggaacgcagagctcgccctagttgagagtcggaagggttgagcacttgctctgcggcataccaaaaggggaaattcagacacagagacatgcatccagggaagaaaatgtgaagtggcatgcacaagagtggaccatttacaagtcaaggaaagatccctggaagagatccttccctcttactactcagaaggaaccaacccagctggcgctttgatttggacttccagcctgcctaaatgtaaccaataaatttctgctgtttatgccgccatgtttgtggtactttgtcagaatagccctatcaaactactggagattctgttgccaagcagtgggatgatgtgataaggaacatccggaagattggaagaggccttggaactaggtaatgcatacaggctggaagcgttgtgacaggcatgacacaagaagcctagagtgccttcaggaaacggcgggggggatatgaacaccaaatgacattgaaacgagggttaagaaagaattctttgctgtagagaaaggatctctgacttagagaatacatatatcatgatcaccaaaatgttgctagaactatgtgtgttaaaggtgcctgtggtgtgttttcagacggagactaggaagaggttattggaagcacgaggaaaggccatcctagttttacagtggcaaaggtttgggctgtattgtcttcatagtgtctttgaggaaagta

SEQ ID NO: 1720 - DNA, 1600 bp, artificial
  synthetic oligo
tcttggtgaaacttacctgaaaaggtacctttactttaacgaaaacaaaacaaacaagaaaaggtgaaaacccagaaatatcagctgcttgtcttctgctgcttgtgggccatagtggcctcggctgctgtgggatctttcatgttcaggcattcattggaggttgtctcagaggaaggctcagccatcttggaggcaactgccagtggatgtgaggaacggacaatgatggctgaccaccagcgggatggccttttgtagtcaccccatggcttatgtcacgggccagcaactccacatctgactgaatgaagtgccacgcagggagcctatcagcaagcctcctggccttggaggcgattcgatggtctcgttgcttggcaatcactgtgggtgtcggtcgacctgctccccaacactcacctgccgcagagcaagtgctcaaccctgccaactctcaactagagcgaggtctgcgttccacgcattcttccacccttgttctctgactactccagttccagacaagttgggttgtactaggatcctctctaaatcatattcctcatctgtttattccttatttcttcctccaggagcccactctctcttggaagagctgaggatcctcgctcaacatggtgtgtcagggttgccaaagacctgatgtgtgaggcttctttgccttttcataggtagggtgagcaagcaatttcctgttgaatatatgtgagggcagcatttggagggaatggggaactacgaataattgggctggcacaataggcaaaatcaggatgtgtggccacccttctggggaaagatctggcaatagaataagaacgtcccttgtgttttgggacaaaaagattcgtgggcaatgagactgatttacttttaatagcatctttttcatgatttcttctctttgacattctggtgcttttgttttctggaggcaactggtgtggctaggctgcattaacatgggaaagcgacacaacaccttgagaacgtctgtttgggtcataggactcatgtaagctagtgggaccggactcgacagaaagagtgattgagggcatcgatttgggagtcagaggagacctgggctgagaccccagctgtatctcttactagctgtactgcgattggcaagtggcttgacctctctgagcctcagtttcctcctctgtggaacaggggtctagaaggtggttgtgaagatccagggtgatgatgcagacacggtgccagatacatagtcagcaaccaatgaatgccggctgtacctggtcccaattccgagatttgtgccctcaggcaatggcaggtggtgggggtgggatccagtgccagacagctgaatgaacacgctctcctggctacctgggccccatctgtttgcttcgagctgacagtgagataagggacaatgactttcccgtcctgagccacatgttagtgaagcggtagagataatgctgctctgagtcctgacgggaagttgctggggagcaactttacagtgctcccggcttggggcactacccactcggggctttgtgacaagttatttccactcactgccacagaacct

SEQ ID NO: 1721 - DNA, 3150 bp, artificial
  synthetic oligo
tatataaactatataaaaagaataaataaatatcttagtatcacccatccacaaaatgtatgtgtttttgatgacataagtacatcataaagttcaagaatcaatacctctccaagctccctagaaactgaagttattactccaactacttctaatgtatctgattctgtctgttcttttccaggttatattgttttatttctggaaatacccaccttcatgacttggaactaacgcatcgttgggatgatggaaacgtccaatcagaggggtccaagccccactttccactggctcagtccatggccattggccacagtgcttgttcaaacagtgtgggataaggtcgctcctgtagtcactccctaaattcctccggtggcctgaaacctgtcctctctagaacgctgaggtgtgtgctgtcgtaggctccatagagagggatggattgtcattggagtgccacattttaggggagccctgaaagaggaggttgatgagggaatttggaacactcgggggcccctaatctggaggctcagatattgagaccaggttctagtcaagctactattaacaagtactgatttcccatattctccttaatgttgttctgtgtgtctgtttatgtatggccagggccccagaagggagaaagagcatctataatggttagaaactccatgccacttaagggcaatcactgcggcatggagaaggaggatccactaaatgggagaggtcaccctatagtgataggtccaacctaaaaccattagagagcctaccgctttgacccagagagtaaagcacctcttcttttatgcacatgctccatgtgtaccacccagcagcatctcaagaattgtatgctgaataggccgcatctcagaaagactgctcattcctgaatgctcttcccgttggcccattggtcgcatctgtttgcccctccctctgggctcccgacaagcctgtgatggctttgacacatggagaatggtggacgttagcctgtcccagaggtaacctttcagaggactagaatggcctctgcctggctgtctgagagctctgagctgccacgaaagaagcccacctctcctgctggagacaccacagtgatatgctctgaggggccttggagaggtgcagaggcccagctgagctcagccctccagccagcccctccaaggcatcaagtatgccagtacaaggtgtctgggaccttccccaatgaccttaggcatagggtgaataaatagcactgagtgcggctcctctggcttctatttgcaagggacacttaagcacagtggagcctgtctcctcattgcatcataggtcacatgggtgatcttgtggcctggttctcactcacggatctgtaggagtgaaatgcccatcgtgggctcccaagggattcaacatcttctaggctaacaaatgtcttccaaggaggctcgcttgacccgggcttgttctacagttcatctcgaggatggcctgtgggtaggtcatcagctactattttgggggatactggagccactgtggaattccctgggacagttgccttgaggtttagcgtgactcatcccctctccatttctccccctgtcctggagcgactatatcccctttcctaagctcgaggacccgctgaatcctatgtctttattgcgtacagctttctctcaagcaggcctgcctctgccgggtaaaagcacggggcaggcagtcgtactctgggctctacatctgtccctcctgccaaccaccctttcgcaggcattcattagaaacttaatctagcatagtacttgatgcctgtcagggctacttactcatgatgcgaccttggtagcggttgacacaatctgtctgatataactcaaaggagaatcaatgcctgcacatcctggaagagagctaggaggggaatgagtgaggactacacttgtgtgcattacctacacagccgagtgcctgccacatggtaccctaagatgcccaatgaaaaatggttacgatggtgtttattgtagtgctggatgctggaaggtgaggaaggatgagatgtggccccatggtctgtgacattgcaactgaggggacaactagcacaggaatgatccccaaggattatctagagaaggcagcaggtgatcaaggccgccatgcctgcatgctgggggtcagaggggaggaagaggaagaggcagggaactcaccacaggcctgcaccagacaccgcatctagcatgctacatggactctctctttccttcctcatcacaatccgtctgtggggatgtggcaaatagtatggccatgtcacagttggagatcctgagattcaaggagggagtagtggctctaggctgggagggtcaggacatcttcacaggggagtcaggatttgagccaagacctgaaaagtgaataggattcagatagggagacggtgggtggaggaaaggaggtggtatgggaagccaggttccttggccgtgagggggaatagcttgccacaaagccccgagtgggtagtgccccaagccaggagcactgtaaagttgctccccagcaacttcccgtcaggactcagagcagaattatctccaccgcttcactaacatgtggctcaggagggaaaagtcattgtcccttatctcactgtcagcccgaagcaaacagatggggcccaggtagccaggagagcgtgttcatacagctgtctggcactggatcccacccccaccacctgtgattgcccgaggacacgaatctcggtattggaaccacgtacagccgacattcattggttgcagactatgtatctggcaccccatctgcatcatcaccctggatcttgacaaccaccttctagatctgtattccacagaggaggaaactgagattcagagaagtcaagccacttgcgcaaggcaatacagccagtaagaggcacagctgaggtctgaacccagatctcctctgactcccaaacccgtgccctcaatcactcttgcagtcgagtctggtcccactagctcacatgagtcctaagacccaaacagacgttctcacgatgttgtgtcattttcccatgttaatgcagcctagccacactagttgcctccagga

SEQ ID NO: 1722 - DNA, 1750 bp, artificial
  synthetic oligo
gacagtgacagatcgtcgttcattaggttcccataaggagtgtgcaagctaagatccctctatctccaatgtaactattagactcctgacccctcatctctctcctacttgcaggtaggacctttactggggtactcaagttaaattacattcattagggtgcgctctatccaaaatgactagtatgcattttgcataccaaaaggggaaattcagacacagagacatgtgttcagggaagaaaatgtgaagtggcatggcgagaactgggccacctacaagccaaggaaagatccctggaagagatccttccctcttactactcagaagtaaccaacccagctgacgctttgatttggacttccagcctgccgaaccacgacaataaatttctgctgtttatcccaccaggtttgtggtactttgtcagaatgaccctagcaaactactagaggttctgttgccaagcagtgggatgatgtgataaggaacatccgaaagactggaagaggccttggaagtaagtaatgcatacaggccagaagtgttttgatatgcacgacacaagaagcctagagtgcctttaggaaatggcgggggaaaatatgaacaccaaatgacattgaaacgagggttaagaaagagttctttgctgtagagaaaggatctctgacttagagaatacatatatcatgaccaccgaaatgttgctagaactatgtgtattaaaggtgcttctggtgtgttttcagatggagactaggaagaggttattggaagcatgaggaaaggccatcctagttttacagtggcaaaggcttgggctgtattgtgttcctagtgtctttgaggaaagtagaaattgtaagtgatgaacatgcacatgtagctgatttctattgttggagctcagggcacaataccccaaaatgagggcttcagaagtagtctcagatgaaaaagattttctctgacattcttggtcctcctgtctgtcagtcccattctaccccaggggctaaacataaagaccagaatccctcttcccgaaggtgggtccaagaaatcagaagctcttttttctaaaggtagtcacaaaacctagaaatgtattgtaacattttccacattttcatgtaaaaactgtctgtgaaaaaatcatctaacctatctcgtttgaaaggaagtcacaagatcgccattccagagagggtcctgccccgtatccgggaggaagtactgtgtgctcagacaggccaagcggagtctagacacacaggccttgtcgggtttcccccactctgtctattggcattagatcatagcctttttgtcccatcatatttctacacggctgtctgtattcctttgagccaaggcataaaaacagataatttcccatgtgtctttggctattaacactaaaggctcccggggatacacgttgtataagttggtatgccttatgtcctatggatctgccttttgtgacttcagttttcagcgaaacttaagaggagcagggggaaccttggtcactacactggcaaactgagaaaagtttttaggatttaatctggtttctcctagatctgtatattaaatgggagagaagagagagaaattagccaaggaagcactaaggaaaaggaagccagcattggatggttcagaaggtactcaaagtatgcagacaccttgctctggaaataggtgcaagggtgtgcccggaaaaccattagcctaagag

SEQ ID NO: 1723 - DNA, 1200 bp, artificial
  synthetic oligo
tcaaatggactccagcttacagggaaagctgataaaatgtttgactggactatgtttatcccactcatgctattttccctacattgatacttcttatttgttgtttaggtagcaaagctctttcccttagtttgtgtttcctataagtcgcaacatgacatcatgattgctcgctacgtttcccttctgctcaatcactcactgaaatgctatatcaaatgtgcgagcttcctcttccgatcttcgcatcaatccacccccttcctctttcttcctataattcaccaacatcagtccccttgccacctcattcttcactccccacaaacaaatcagatttcattgttaaccctgttttactaatcctcctctttgatttctgaatttacaaagggaaaacacatattccagggtaaaatatcccaatggatctggtttctcaaaaggacttgtctaattacacacatatgcaagggtaacttcagaaatttattcgtatgtcttaattcacagaaacattggcactttacagcaaaacaattagcataatgagaaataagtcactgagtgagatgtggtgttttggaacaggtatacagctctgtctctagaaaggaacagggttctgccaagtgtctttggtttggcaagggttgttctggacttgtaggaacatgtggcggcaccatccagagggatttacttgcagctgattttgtgggagtttttcttggtctccttgtgcagtaagtacagcttcaactattttcataacatttctcttcaactattttcataatatttttctaatattctggaaaaacagaaagtaacaaatcccagtgagtggacttcttggttctatatcatttctctatggatcccaagtggagctctggaggtgaccttcccctcttcccatctgcactactcagggaagctctggctactatcctgccccgaacccttttccctcttgaccaaggggtcctctttaaatggtgaaataatctatgtggctatgtgttgggtccctctggggtggttctttcccacttctgacgggctcaagaaaattttgatttttgtcatttatccagcttttgcttcgtggtttgactgagagtgccatcctttactggtttctacatatgaaggagaagggttgtttatgagatgtttcaaaatttacgggaaaca

SEQ ID NO: 1724 - DNA, 3000 bp, artificial
  synthetic oligo
tctacacctcagaatcaactacagggctggttaaaactacaaatcacactcttcacccctagtcctactacatcaaaatcccccaggggtaaggcccaataatctacatttataacaagctctccaaaatgattctgaggcagctcaccttgtactcacactttggttaatagcatgagttctggattcagagactcagttcaaattttggcttcaccttgtattttcagacaaatcattttacctctctgagcctggcctctttggggtcacaaagggctgtcgaaattatgttgcttttataaaacaggcagcttgttgtgtaaaaagaaaaaaaaagaagaaaagaaaaaaagattaataaaaaaaatgaaagaaagaaaagtaccaagaagagtttcctcttctgtacaatgggcaccataaaggttgccctcatcttccctcagccctctccccactacctcctcaccccctccctcagcactattatcacattgagactgctgttgagatggtttgagactacctgtgcaaaaatactctccaggcagcgctgcagggcaacgaattagcatctagagagcaacagacggtgctaggttggatgctgtaacttatttgctgcaggatacaggccaaaactagtaacctgtctctctctggctcagtttcttcatctgtgaaatggagataatggttcttgctcaccaattctatgcaatcccaagttggtcctcccatctggctttggtttttctccactatcccttaatctgacagaatagaggagtgctggcaaggggcagcctttgaagtcagacatggtgacttgggtgtgagctcttaactctgcacttcctaactgtactgcctgggtgcttcagtcctttcctgttaaatgggcacactactacctccttcacacggctgctgagaagaggaaaggagatgtccatgcaggcgcctctgcacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgca

SEQ ID NO: 1725 - DNA, 1400 bp, artificial
  synthetic oligo
gccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccaccgcagcagccgacccaaggttttggcttcatctctgagccgacccgtacggtgtgaactctctaatttgcgggccgccctgggctagatagcccacaattacccgccgtggaagcagattatttggggcactagtatccatgcattgttgtaccactgggctctttgccagcagggtctcggatacttaggcttccaccccttcttgccgcacagaacgcgttcttctccatgcttccggcttccccaaagatagcaattgggcaactaccctgggacttagggagggtgaaattcccaagtattcctgagccgaggcttcagcagaagtgcctatcttcgccacttgcatcccttctac

SEQ ID NO: 1726 - DNA, 1100 bp, artificial
  synthetic oligo
gtcagaaatggagagctctaggtcagtgggaagaattattcgtataaatcttcttagaagaggtaggtaattattaatcaaaaaataaagaaagaaacaggaaacaagtccccccacatcgctttccgaccccggagttagggtgcgcagaatgccgtctgggagctccagagaaagtaagcagtgtcgggacatttactaaagtgctctctgcagagcatgagtttagaatgcggttagtttatgcaccgactccccttcccaggaatgtttcaaggggctctttctcaaagctgaatcacgtttgtgagattcttttaagccatatgtcagtcccccagcgctttaaaggaaaacggaagcaaacaacttgggcacttggaaaagttttgcaatgaatgagcgaatgaatgaaacccggccggaacgctggaggctggaagggatgcaggaattttctccgcgcgctgcgaatacggcatatgcaaaacttaggacccagggcaggccgggctttggagacgagtcagtcttactcaaccctgcgcacctgagaacaggtgctgttctgagtgaacgactgggacctggcacgaactagcctggggccagaggagataaggcctgccgggagaagagttcccagcggctctgtccattctgctcttgccctcggctaatggctttgaaggccaagctgtgacagccccggggcgtactcggtgccttcctctgttcaaataggtgctcgcctaggactgattcccaacccatggcaagtcatttccttctgtaactcggtaggtctttgcaagaaatggagcgataaaatcagagggacagaaagagaaaacagccaactagaaaagtcagaagtgtttcttgggaagtctagggcgcgggttgtttggactgtggcagggctgtggggcccagactgggagcggcgcggagcgagaccggttttccggggctggcagctgcctggaaaaagtttcctgtggaacactcgccagcgggggcgggggcaggggcggctggcgcagcagtggacgtgggagggggcaggagggccgggggaggccgcgaagggcctgctc

SEQ ID NO: 1727 - DNA, 1900 bp, artificial
  synthetic oligo
ttaacaaatgttgagctgcataaagtagactgtatttatttgaactgaaaaagtggctaagactgaacatcttgaacatcattttctctgatattacctcaaattaaaactttaatattattttagaattgtgtctctgaacctgtttaataattttaacatgttttttatattgctaagcattgttctaagtgctttattacatgtattaactcatttaatcatctgaaaactctgtgaggtaggtgcaattattatcccccttttacagatgatgaggaaactgagccacagggaagttccccaaggtcaaaagttattcataactatcagacagcaggtatattaattcagcttaattcaaggctcatttgttaaccatctagtaaatataatagttgacagggtagacaaaaattgaatacttaagcaaggataaatcgtaatgtaataatgccatgagtgaatcgcctaggcgagtcaggctcctttcagttagtgggaaatggagaaagattatgtagttaaggtcatgaatagcgcaggaacatccgctagggtaagtcaggtttgtgaaaaatgcagaagaaaggcttggttctgaggtgtgtgaaaacagtcattcttttgtgaggactaaaattagttttagaagaggcatctgatgcggtacatgaaacctagggtaacggtgaggaaatacacatgtatgaggcttcttaggagcagggaaagagaaaggtgccatttgaagtcagtaagaaagggtaacagcgcgcttttcctgcccttcccccctctagagaatcagtaaatagcctgattctactcaaattccttccctacccaaattcccttgactacaactcagaccctttggatctgcgctttttagaagtactgtacttcacattctggcaccgtaagcccgaaatgtcctttaggcaaatgttaggagggaaaaatgtattcttgcaattcaaaaccgactcgaatcctgccagaaagctttatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgca

SEQ ID NO: 1728 - DNA, 1800 bp, artificial
  synthetic oligo
tgtgggtatacctggaagaaattgcagagtaaacaggtagaaaagccatccagttctggatagcttttgccacactgtaacctttaagggtattggaaaaggatgtggtttgatggggaaggaagtaaaaaggggaaggaaaggtaaaaagaaaggaagatatctctcaacgtttgctacatttactgatctttctccaggaagagaagaagaaattacctcccttagtacacattcaaattgcgatggcttttcccaaagatacattgcagtctggactctgaaaggattatctctttccaaactgtccagatagctgccttgggactacttactgccatttagtagaagagaatcccagattgccccttttctcattcacaagaaaaatccctgcttggagcacacgcctgcctcactcgagatggcacacatcttggaaggttaccccagagatgctcctccagggcagagttccttggcttggcatctgcgtgtgccccaccccatttttttttaatccacatgactttgaggctctattctcaaaacagcttgccaagagccctttgcttatacatggcctcccaactccttcctccctctaaactttttttcacttttaatgcactctttaattccggtggacttagttattgcaataaataaaaacatctgtcaaatatttcctcacagcgatatcatgcaaattattgacctcattcaccttagtgttcaaaccgctgcgcatcattgccaagatacaaagagatcaagtttgcttccaaagggatttttttaagagtttaagaaaaaaaaaaatgcacataaattgtttagattccaaaataggaagctggacaagagattttctgtggttcattacagcagtttaataaacagataggggcgacagtgaaggaaaggagcggtgcacggagtgaagaaaacgcgtggcttctggaaattttatattcttcctatataaccaaaaagagcttaatctaggcatgaattttggatttagagaaggaatcgtatcactgactgtgtgaccttggataagtcgcctcacccgacagtgctttcctttattaatgtgcaaagcggggacgaatgtccacttcgcaagactgctgtgaggattacgtgagatcgcctgagtctatagtgagagctcattaaatgttagttgttgctactgctacttcctggaatgaaccgatattccaaaattccagaaactttgttttctacagtttaatgccttcggctgtaaaatgataaaaagaagcaacacctttacacctgggactcacttatttgaaccaaaaaaatgctttaaacttcagataggcaaaacacacttaactgatggctgggacccgctttgaaagcacccccacccattctcaccccagtgtattgtgggaagggtagtcccatgttccagtcgcttgagcacagaaaagcgcgtaggaaactacaactcccaagaggtaaagaagcgggactatttcccagtctggcggtagcgctgtgggagggaattggcaatctctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtcca

SEQ ID NO: 1729 - DNA, 2250 bp, artificial
  synthetic oligo
tacaaaagattcctatgtgtaaacaacccaatatgcatatgtagcttaatcttggcttctatagtaaatgcatttaacccaaaatggtctacagataaatatatatcaaatgttttcttattatttacatcatttcaaaaatgtatcctcacagaacaatcatctcatgttataaaaattatattcactatttctgctgtttacttcaaggagtattgtacccttttgttgcattttatacacgaatttactcttccacataacctttacaaggaaaattggttaaatgaacaatcttccaagatatttgcaagcttgttaaaagcacacacatgtctacacaccatggggttaatttccgtttccctagcagttctcactgtctgtgagactttcatttagtggattctgatggatatctgtaatgacggcacagccatagcagctacctaaagattgatggagacagcagaaatactgaatacaatttttataacatgagatgtttgttctgtgaggatacattttggattaaaagtactttcccacatagaacatgggctatacactaggtcctttggatcataatgtacttatatattaaatgcgcagtgcagagaggtaccatctcaagaaaacctgcttaactaagatagaagacagaaaatataattaaggattttatcatgtttcctaaatacttgagaatcctttagagccatgcttttctctgaaattgcattatcgggaatgtgtcttgttttcgagtttattgatattcacacctactttctttagtttctaactttgacatcatataacgctatgtttatccaatctgagaaagatttgagagggcattctgttcttgtatctataaggcagaaacaagcgaatttattttaactgaattgaccagtggtttctgtcaaacaatagtcaatttcattcgaattaccaataaaacccaggtatttaccaaaataaataaagcagtttaccaaattcttcacttttttcaattggttgttttggcatgtagatacccaacatggagtaaatggagaggaggaaagacggagaaaattggataatttacggggatctcttaagtcttcatatgagatttcattatttttctaagtgaattctaagaatttcataaatgaataccttgaatgtgataataataacacattctaaagacaaatgtaagctaatttttggttgagtgctgctttagattactcacacatttgctgtgctcctttagtttggattgggaattgactgattttcaaagactgatagctaaaaaagaagttttctaaatgaaatagttgagttgcagctcagtagctatttctgcactttctttgaaaatagttatgtctccttcagtaaaccttaaaaaggtttttaacccagatatgtaagtcaaataattttgttaattatataagataaaaatttcattatgcgaatatgctgggaaccaggatgtcctttgcttaaatctcttgtgagcaacatcaacttaaactctctaatataagtataagcatgtaagtctctaaacttgagttcactgtagagattttttttgtatttacattcatgtattattgtttgcatttaatttctaatgaaaattaacactggatgaacctttgatcactgcctagactgtaacttctgaaaatgcaaatacattgtcaatgtaaaagtagaggtattgggtttaaatgtttgttcatatcttatagtactaatctatggtaattattcaaatgttattttgtggtgacctgaatacttgcttcatttatttactcactcattcatttatttattcactcaacatttataaagtcttccactagacactaagggagcaccaagataagatacattaatgtccttccatgaattgtacatggataagtatttggagaatttttattttgtttaaatataaatctcagtacagataataagacagtaaaacagacgacgaaaatatttcccttctcctaagagcctaaatcagttgtacagttctactgttcaacattttattatgtgaagccatactacttagaactacacagaaatgcaggcgtagatggatcattccaatggccactaactgtctcttttgaatttatttctctctggacagagaagtgcacattatcattggaactccttcttcagctgatttatagttgtcttttagtgcaacgaagc

SEQ ID NO: 1730 - DNA, 2200 bp, artificial
  synthetic oligo
caaagctgaaagaaatacgagttctaaaagtgctctttttaaaattatcaaactaagaaggggcaggaaatgttgtgttatttcatcattttgaccagaaggaaggcataagatatctttctcatttcacaaatgccattgccaaggcatgaagattggggtagctcccatacagaggccatggagcttaatgtcccaacaaagctgccttccactcatcctttaaaaaggaatgggtggtgtgagtccttactccagtagcaggaaggagtcagaatcagccccatgggacgaggattctctccacgttgtctctgcaagccctgtctctccccatgtcccctaacagtggctccagaagttctgccatggaaggggtgtctgagaacactggttgcctgctcctttaggactgctgcaccgtcaccccctagacacttctagcataacccagacctcgaagactcagtgactgtctcctggaatgccacctggactgagacttcttccttttcttttttctgtctcccatagcgtctggcacatagtaggtccataataaatatgggattaatgaattgtctgaggtaaagagggatggccactccctggctctaggcactgcagtcaggatcctgcctgccagggccccatctccacaggcaaactgacttagagttgccgtttgttcccaatccagtcagaaaaaaatggggaaagtggaggtagggacacaggtattcaaatgctgctttgcaatagcacaaggtagcttttgagacaggtagcccggaatttgagatcctttggggtttaaatcagtcccaccacatattattagtgcttgtactgggggctctttgctttgctcctctgagcctcaattttattttccgtacaatggagaggatgctggaatgagaaaataatggatgtaaagcacagtgcctggcacttagtaagtaagcaagtggcagctggattgtctgcatatctatgtcctcccagcctatcccttcccaggtcccccgagtgggctggtccccggtggcgaggggaggggtcctcctgggggcgccgactgtcccgggcggcggccggattgcgggtgggtgagaggcagcagacgccgtgtttacagctctctcgctagttcgccacctcagccgcggctctagggctgagccagtcgcctccttctttaagattctggtcacagcaggggctgggtttctaaggcaggtttctaaggtgtcttcctacagacaccgctgctgctaccttgctaccttcagcgctgggcacagccaggggcagcgcgagagggaggcaacgagagggttcccgggccgggcagcagcccagccccggcccggaggggggcccgacggtaagtactgcgctctgagcagccgggttggggggcacctgaccattgaggcaggggtctgtggggttagggggtcggcagtcgagcgctagggtccttaccggcccctcaaagtgacttgagggcggcgctggcatgggcccccctccacctggtctttggagtgagttggcgcgtcggaagcagacatccatctccgtccctcaccccgagatcccaaggattcgtttgggttgcctggcagccctccggtcctttcgaggccacgaaagaggaaattggaaggcaagatacgcggggatgaagttttggacgctgttggaaaagtggcggcgcgagcgggaagttttccgctgcggggtgcgggggatcggggagataaggggcgaggggaatcagaagctgggagggaaaccacccgagtggagcaggggcggaggcggcccctctgagtgctaggaccccactctccccgccgttacgcttcggaagtgtccgggacttctagctgcctctcccacccctgcccctcagcgcctctgcttccatggggccgggataccctagctggcctgccctccggtagggcgggttggagcctcagcgttcgcgaagctccgcggggtggagaagcaagaccacccttcgaggtggtgcaccaatcacagaaatgttagcaatcgggaatatgcaggagcatacctatcactttcctttcttaagctctgtaaaactcaggggagaggggcctgagatcctaaaggcgagtttatcctaactcagtcccttctcagagaacacccagatctt

SEQ ID NO: 1731 - DNA, 1900 bp, artificial
  synthetic oligo
tgaggaaagggctgcttgcagaattgaaggcagttaagggcagttagtccagctcagttagggacaacccagggatgaatgtgctccagccacacctggagatatgcctgcacctatgaaccacatagctgggccacctgcaggaagatggaatgcacctatggacagagtttggttcttgcctctctccccaactctgccctttcttggccagtgagtacaatccccacttcctccatggagtcttctccagcttctctgccccatcttctgaacacccaagttggaacttagttgtagatctcatctaccagtctcagttagcactgtaattgtcttgttcagtatgcccacttgtcttttctcccccagctagactgaaagctctttgagggcagagacctgtcacttctcctgtgtcccccagagtgctggactgtctgagtaggcacttgataaatacttgttgattaattaatatgagtcaaaagagtaaagcaaagcacttgtgtcacaaaacgctgtttgcttattgattcctctggctccaggagtgcccattttcttcagaagtggtagtacctcaaggcccagtggaaactgagatgtcctctgcttcaaaaaaggaaaaaagggcaaaggggaggctgcagtggcagggatcaagggggagcactgagcgtaggacagtatcccaagtgcttctgcagcacacctgtgtctgtcttccttgccggagttccttctccccacgccacagtctgcagagccttccctggctgatgcccatgtcggaaatgagctggtgccatcccaagaagtccttttagcgccaacaagtccgggtggcaggaagcaaagggctcattttccaaatagccctaggggtgaggcaagacggcagctgcaggaagatgttctctggcttccttcaaggacgagctcctgcctgccaccaggagccaaaatgaaagaggcgccagcctgtggccaccctcagagggtccctgtcctaggagtgtgcctgtccaggacactaatcagccacattccagcttcggagtgactttctattgaaaagtgaccatttatcttagtggtgtgagagggaaggagcaagtttctgaatttgccttccagagacttgacctcatcctagcatccccttccacctcccgaaggggtgacagacagactccaagccagtgtgaggtgtagccagagagatctcatatgatagagacaacttcagagttctttgctggactatgaatttctcttttatacaattattctaaatcttttccccttcccctataaatagtcctaaagcttctctctattactgaaactgtgtcctgataaataacctaaatggtttgaagcatttgctactgatgaatttgatattcttagctaataaagaattgcattgctctcggctaggcgcggtggctcacgcctgtaatcccagcactttgggaggccgaggcgggtggatcgcctgaggtcgggagttcaagaccagcctggccaacacggtgaaaccatgtcactactaaaaatataaaaattagccaggcagggcagcacacgcctgtaatcccagctactctcctggagcctgaggcaggagaatcgcttgaacctgggaggtggaggttgcagtgagccgagatcgtgccactgcactccagctggcgtaacagagggagactccatctcaaaaaaaaaaaaaaaaaaaaaaaaaagaattgcattgctctcagaatgtcaaaacctcctacttcttttacaaaccttatactagtttcattaattagctactggccctctgtatcttgttccaaagggctctgcctggaaccataattttagcaaatacacatactgaggctag

SEQ ID NO: 1732 - DNA, 1900 bp, artificial
  synthetic oligo
agaaagtagagtattgaagtctcctactactgttgttgaattgtgtatttttcccttcaattctgtcagttttttcttcctgtatttgggagttttgttgttaggtgccagtgctgtacttttgtcatagatgtaatctctagtgaaaggcaacactggcatattgactctgtcaaactggagtttgagtggcattttgaaggcttgttttccagcatcttgaccaccatgatgagttataagggtaatggctaaaaacatgggttttgaagtctttcagacctaggcggaaatccagtctaccacttggtctatgtaaccttaggtgagtcagtttctttatccttaaaatgtgaataatgataataactacctcattgggttgttatgaagaataagtaggatcatgtatattaggaccttagcctaagttagtgcttgtttgttatctgtctgtctgctgtccgagtatattctcacagataaaatggggaagagctccaaaaacagtgagagaaggtattcacagataaagcatttgctatagataattctcagatgcacacacctaccatcattaagagcggttgacgagagcatttgccatatgtatgtgtagcaggtagggctggccctgcatgaatgcagaaaagaataaaatttgaagaattataagaatgcttcccctgccctcctcccacatatgcacatcccagcatatctcccatatactttacacattcagaccccggaattctaatatagagccttattcttttaggatccctccatcaacaggcctctttgaaatgcaaactcttcggcattatatgtagcctgtttaacaggttctgactaaagcattagtaacttgtcagatttatttccttctgctagaagagattcaagataacaagaacaacagagcactggtggaaaagctctgaaaaggggtggggacaggggtaggaacagttccaagtgggacatacgtttacagctgactttcagatagagggtatccatgtaagagtccagctgtgcccagataccaggccctaaaccagggtgttcaccccgacccctaccataccccatgccttttcccatttcagaggtgatggggctattagcagctcaggttattagactctattcactctactttcagggtcagcagtaacatagctcatcaacttccctacctctaatctttggcagccaggtaatgctttgtcttgggacctgccacttgattgtgctacagagacatgggccagagacaacaagggagctcattcacaatccttggcaccagggctcatctgttgattctctttctgggtttagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgcc

SEQ ID NO: 1733 - DNA, 1200 bp, artificial
  synthetic oligo
agagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactc

SEQ ID NO: 1734 - DNA, 1400 bp, artificial
  synthetic oligo
tcctacccatgagcatggaatgttcttaaattgatatgcatcctgtgttaccttggtaatgtggcttcagaaatcccttctctcaattatgtgattatgacagtggggagtgcccaagccactgaggtaacatctgttctctctgccttctctagagccctactcactcaatccctcggcctgctcccttataaactaaggatcccaactgcccctccctgattcactcatataaatttgagaataaatctgcattatgggcaagccgtttgcagtttcttggaagtaaatgcaattcctgcttcttagtttgacttatagacaaaaaagccgatatggccttggtcaccaaggacagaattggtagtaaagcaaggcagcaaagacaagcatccctgccccttcctaacctggcgcagcaggaatgtacaatgcctccagggacctgaaaagactcaaggaactaagaagaaactggacagattttctcctgctgaacaatgaaagagacttttatttgatttgcagttcctgcggccctgagcccatattagcttggctctgtaacaaagctgcaagcgaaagccctacaccatgagccagaagactttgattcgacttgcagctcttccaaaaactagctgtgtgaccttgggcattcacttcccctctctggctatcaatttcttactatataaaatgaatgggttgaactaaagggtctattagcttttaaaaagcaccttttctcatcatactttcacttaagcatttttaaacaaaggcaagtacttccagcatcaccaacattcccccaagtcagtaattaaactgggagaactccccagttcataaaacttaagcaccagaacaaactacaaagctcacttggccctgctgtttttatctaatcacctgtcaagaaggactgaaacctcccatattttaaatccctacatgattctagctccctgtcatactgtccttgtacaataacacctacattcacaagaaaccaactcgagggaacccttgaagagtgagacacatctaaaggtttcagccaaatcctatctaaggtaaaacaagccagcttcactttatgagataaataaatcttccagaacaggactcattttaagatagacttatattaataaaactatgatttacatgtataagtcctctgctctttcagaggactcctacgttgaagtctttggagaaaccattaatagtcacctcctggcagggcatggtggctcacgcctgtaatcccagcactttgggaggctgaagcaggctgatcacttgaggtcaggagttcgagatcagcctggccaaccccgttacccctggtgaaaccctgtctctactaaaacaaaaatacaaaaagtacc

SEQ ID NO: 1735 - DNA, 1500 bp, artificial
  synthetic oligo
ccactggcatctttctccctggggttgcttctacaaacgcagctcagagctgccttttggggctatgctggccactttagctggcaaattgggagcctgaaatgagtgaggactgggagaaggggcgaagccaccgtagatccccctttccctttctttcttagtgtgtggcagtgaagccccctcaaccacaccccagcaaggggagaacaactttcctcagagctctcccccactcccacattgtctcctcccactctgggaagcccaaggcttagagaaatgaatccaagtcattaactaattaatgaatatggatggcaaagttgctgaggttgctggaaaacaccctgttgccgccaacacacacagcgcagccaggcacccgcctcccaccatgggcgaaaggaggctaaggagaaactattggactgtatcttcctaaggctctagctgcagcagaagcgcccacaacgcagcagccccttgctcagtgcctggagaccaactcatgggtaacacatccctttgcaagaacggcctcctccaatccagctggggcagcaatctgctcacttgctcagcatcaagggtactctctgtggtccaaggaattctgtctgtagggctagcccagtgcaaagtgcaaggctgcaggagatggatggatggagataggaaaaggggagagaaaaggagaaggagagactgagaggcacacacagctggcaagagcccatctccagctgttgggcgggctgtttcctttgataaagcacttggcagtactcccagttctgtagtttctggcctgcgaaagcacacccggagcacgagcctgcctgtgggaggacttcagccttgctttgttttctttctttcctttttttaagctttagaaaaggcccctcccctcccaaggaaccttgtccctcccccaacacctcggcaaagtgaagttgcaccagcaggtgatgtgggctgggcttccgggtgccttcacagaaagtcagtgccacagagccatgttaaagggcttgggacgggtgtgcagttaagtctcagcatatactttcaggcacatgtatttgagagagagagagagagagaaagagagagagagagagagagagagagagagagagagagtgtgtgtgcgcgcgcgcgcggtgtttaggaaggggggagggagcgggggagggagggagagagagagaaagagagagagggagagagactgagttgtgtgtgtctgagaggctctgcttgtttgttgtggttgatgctgccttctgtgtggcacatcaccactgttctccccgccgaggctcctttcagctcactaatgcttccctggaaggcctgggaaatagagggagtccccatgtcacaagatcacacagaacaacaagcctctctgcccgctggtcttctggctttgtggaagtccgtctctcccccttcaccctccttcataaaaggagcaaggggacttgaagg

SEQ ID NO: 1736 - DNA, 1400 bp, artificial
  synthetic oligo
atgaagtactgatatgtgctacaacatggatgaactttaaaacatgttgagtgaaagaaatcagacacaaaatattgtatgattcaatttatatgaaatatctaaataggcaaatccatagagacagaaagtagaatagaggttaccagggggtagtgggaggggaaaatagggaaacggtgagttattctttaatgggtacagagtttttgtttgggatgatgacaaaattttgggaatgataatggttgcacaacattgttaatatacctaatgctactgaatcgtacacttagaaatggttaaaatggcaaattttatatctattttaccactatatatatatatgtactatgtacaatatatgcatataatacatctctctctttctctttcacacacacacacacacacacacacacacactagtagatgtggggtagggcaccaggctcactcattggtgaaaggaccggcccccacctactagtctccttgcacatgtgattcacatctgtgcctcagcaaaaacacagtttcttaccagtctgagttctcatgaagtatccaaaccatgaatgttaagtttgcaaatgcatttgtgcttttaatggagaaggtcccttaatccaagaatgcctattctttgtcagaccactaggcactcaggaaatagttattttaaattactttgggctatgaaaggacttttgaagcttgataccaaaagcaaaaatcacaaaggcaaagaatgacaggcttaaccacacagaaacccaaaaccgctctacagcgagtaactccatcctcaaaatcaaatggtaaattagttgacaatgcgttgcaatctctaatacagggtttctcacagtgtggtctacataccagcggtgctctgggagaggaattttagatggtacatggacagagaactgaatcttaaatagtatgaacttaggcactgcagcaggcagccactcaaatcatgccgtgtgagtggccaccacctcagaagccaggtccaggaatatacattatgaaattacttgttctgagactcacttagagaagcacaaataattttttgcacaaatttttcttgaaaacctgatctctgaatctatatccttcccctttgttactatattaataggggatattaaatgaattagcacacataaagcaattagaaatgtttgctatttttatcattttctgagcatttatatatgggaaccagttggggccaggtcagaagcttaaaggtagaatcctagggtttttagagctggaagggaaatcggattcagagtatttcagaccacactagccaggtacgctctggggtcaaaggtagaatagagctgattaagaggttttgggtaaaatcttagaaaaaa

SEQ ID NO: 1737 - DNA, 5350 bp, artificial
  synthetic oligo
tcttctagtttgctaatgagcatgtcatactgggcaaaacctaaaccgaattcagaatccccagtctctaaggtcccaattgtcaaggaaaacaagaggggatcagtggctcatgcctgtgatcctggcactttgggaggctgaggtgggcaggtcgcttaagcccaggagtttgagaccagcctgcacaacatggcaagatcccgtccctataaaaaaaaaatacaaaaattagctgggcatggtggtgtgtgcctgtagtcccagctacttgggaggctgaagtgggaggatcgatggagcccaggagtttgaggctgcagtgagctgtgatcatgcaactgcactccagcctgggtgacagagtgagaccctgtctcaggaaaaaaataaataaataaaaataaataaaagcaagagaatactttgtcctcttagaactataagactgttaccacaggaccctgttattcccagccttagcgaagcctgagagcttgctggttagctcctcactggttttgaacgctgagtgagttgctctgatcgaaggaggcagggtgctcacacaaacctttcctacaatttgcgcttctccctcaaccaatacctataatgccaccccactacatctccaccctgtagcatttccaggctttgcctaaaaccaagagtcaataaactcgtattagtggagtagatgacaaaggaggtattccctttccacaaacccaaacaaccaggatgctcccgaggtgtggcagaaggaaacactttgatctcaggcttttagcctcacacttccctcacccaggtttgaccctcctagggccagaaccagaagaggcgccccctctcacactttcctaaagcctggagtggcagtttctctcccagttgaacaaatgcaaatgctacaagcgctctttccaggtttttctactacccctcccccactgccactctccaacagagacaggcgggatccttaggagcctgttagggctttcgcttggcaggatttcaacgtctgtgggctgaatacacttgtagtaatctttcactagaaatgaagattccctcgaaacctttctgcccgcagcctggtttattttattttattatttttaaaaattcagcctggtttattttagacaatgagataatttgatgcctaaagtgaaataatagatgagaaagggcttcaatggtgtcgaaaatgcccgaggaatacgacttgttataataacactaacgaggttagcggccctgcttgtcttgcccagaatcactggggctgggctgagcgggaggcgatggtggatttgtcttggggcaagggaggcaaacctgctcttagcattaagtgagaatagcgcctgcctttctcgattgcttttaaaatttcctatttgagcctgcttgcattctaaatattttgtaggtgctcagaatttcttatcactttgtctgggcacatcgcctgcctacagcctagaatctcagagctaaaaggaaccttggagagactagagaggtcaggcgacttgctcaggctcatacaaacaggtgaagccataacttgtactacaacccaggtctcccacagtggcgatgtctttctcttacataacctgtgttgttgagcaagaataaatcctcgcttatacactcacacacacatgttggtgccctatcctgatggcgctaaggacactaaatccatggctgggtttcctgatgttgtctgccctgcctctaaattgcctcagttgttcccagagactggttcttgccagagtgtctcaaactgaaggacagcagctgccttgggtcttcccattgtgttttttccctcccttgtcctctccttgcctccccagcaggatttctagaaagcttgaccggtacaccaatacacgcctgcaacgacatggattcatccgccctcctgccacacatagttcttgaggcactcaagatgtcctagggtgctctctggggttgcgcttagcttacatttgaaatttaacgctgtgatccatggaggaggcgaatccctcccatccagaggctcaagaaattctcacaagtctctgatttttaaaaattttcccctccccatctccctctcctaccaccagcagtttaatttgtcttgacattttgcttgccctcactgtcagtcaggggcactcagtaattttaaagcccttgtagtttcaatctgattttgcacatttgagatgggcttttgagaagggtagaacttggaactcaagaagaccccatggcagaatctccaaaggggctatggaaatgtatgcatttgaggagcgggtactttcagctacctccaaaccatctggggtctgcccaccttctaggccccagcgtccccatcagaaagcctttgcaggcagctttcagaatagggcttgcacctgccagtcctcccctcagctccgcggtactccaggcaacctcaaggtccagtcactgtagcctgagtcagacctccccagtacccctcctgaacttcctagttgccccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctccctccctccccggtttgcaggctctcaggctctcgggctcccctgggctgtgacggctgagcggtggcaggagctgagagcgagtgagctagttagcggtctgcacgcccgggagtcagcactgggatatgacagcatgtaaattaccctagaggggacggcggagaacggtcctccgccacttctccggctggcgggcgggggccccgagcggctggatcctgtccctccacccctcgccccaccccgcccgcacccttgtgccctggcatccacgctgccgctcgcaccctcgcccgcgctcctgggagccggcccggctctcactctctcggcgagccggacgcttcggttcaggctctttcagcgctcatggcgcatcctccgccagaaatacgcacgcagcccacccgggctgccgtgccccctcagtggcccggtctcgcggggctcgagctcggcgtgagggcaaatgtctctagtctcacctcgaatgggtccccctacagaagagacgacgccctcgagagccccaagtgttgtagccttaaactgccgccctccaaagcccccctttttctggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattcacaagtctggcctttgaaatagagcagcatatactgccatctagtgtccaagacgttgaacgttctctgcctgcgtcacagaagctcggagaggcaccagaggtacctcctggtggaatccacagtgcgttggttccaagagtagcagggaagaagtgtaggaggcggagctgctacactaagagagttctgtggccaagctaataggcaggaacacgctcctacactaagagagctccagctaataggcaggaacaccaattagggccagagccgcccttttttctagtggagcttcacttggcctgagtccctgcggattggacttccatagatttgaaacttcctccgggtaccacaagcatcaggcctgtgattaagagcaaagagcggccaactattgtaactcttattcccaaggccctgtgggtcctatatgtgccctgcaacttggggaaaatggaggtggggttgtggtctctatgctgtagcagccggaaagccaa

SEQ ID NO: 1738 - DNA, 4150 bp, artificial
  synthetic oligo
atgatgctgctgtaagcgtgggtttgccagtatctttttgagatcctgttttctatttgcttggatatatatctagaagtaagattgtttaatcatatagtagttctatttttaattttttgaggaacctccatactattttccatagcagctacaccagtttacattcccttgcatagtggctgtacctttttacaatagtgtgcaagggttccaatctctccacaaccttaacacttattattttctgttctaattttattttttgtagagacacgttctattcatgttacccaggctgatctctaactgctggtctcaagtgactctcttgcctcagcatcccctcctgagtagctgggattacaagtgtgaaccacaccttgccgtattttcctgtgtgtttgttttgtgtgtgtgtgtgtgtgtgtgtgtgtgtgtgtgtgaccatcctaatggatgtgaagtgatatttcattggggtttgatttgcatttccctaacaattagtgatgtggatcatctttgcatatgcctgttggccacttgtatatcttcgttggagaaatgtctattcaagtcttttgtccacttttaagagttttttttttaattgagctatagaagttctttatacattctggatattagcacattatccgatatatggtttgcaaatattttctatcattttgtaggttgctttttcactctgttgattgtgtcctttcctgtgcagatgtttgaaagttttatggtcccatttacctatttttgcttttgttgcctgtgctttaagtgtgactcactaacttttacttctcttaggggccagactttcatcaggagagcctggttgtgacttttgtcttggtttccacctcagtgctctctagcacattgtttaacaggagtgttgactgattactattggttccctgaagggatataccaagagatacctcaatttttctggacttgttcctatgcacaatgatgggaggcgtgtgtgtgtgtgtgctggggtgagtcttcccattttctcatttctttccccttcttctccctttttgccccaagttagaaacagagtctcttatggggcttcctgctctttccctctcccatccaccttttgagtcgggtggtggtctctgagccaatgacaggtcagcaaacaggctgattccagaccaatgggaggatgctggattccaaatggaccaattagcttattagggacctggaatagctggatagctagcatctgcctcattgtccatgtggtaacgaccctcttgttttactggtcaacaatttgaaggtacaagaaaaatcctacttttttttttcttttgatggttttaatccacctccacaacttctgcccgaggccaataaaacacagccattctttttttgtaaaaagaaagagaggttcggtttccttcaattgtctgcccttttctatctcctccactatttttgttttactctgtagttaactttgcatagagcagcttcatagggaggatctctgcggtggacccggctctctcttcttattacccgttgcaaaggcctctttcttgttctaacctgggggtttgtggggttgggggacagggggattggggagtgggagaagagtttagccatagccttccttctgcatttcacacacatttagctatctctgtcgctctgtcacacacacacacacgcacatacacaccatacacacacacacgcacacccgtccgggtccctctcggtgtgtcttccttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccc

SEQ ID NO: 1739 - DNA, 1300 bp, artificial
  synthetic oligo
tcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgttagtgaagagttttctctgtactccaccccttatatttgggggacaattgcataaaagagcattatttgtgataatctagtaaaatcttactacagagaagccatatctgttaggaatgcttttgacagcaaataacaaaaagtgcaactaacatagcttaacaaatagcgtttgttaattgtttaaatgaatagtatatattttatctctcacacatacacataggaagaagtttgaaggtaggcagttcagggctaatgcagctgctctgcgatgtcataaaagatgcaggctccttctccctgtgtgcattggcttcttgccacatggctgcaagatggccactgcaactttcagatgtcatattacctctcaagataggaaagaggaaag

SEQ ID NO: 1740 - DNA, 1700 bp, artificial
  synthetic oligo
agctcaatctccaacttctagggtacgaagttgaaagaaaatgatggaatggaaaaaaggtaggacatatcagagcaaacataataaaaacatgggggcaagaagacttttaaaaagagttaagagtggttgcctttcgtgaatgggactcagaaacgggaaggagtcgggcagggaactgctgtttttgtgagacatgtagtagaactatttgactttttaaactatttacttatattctcttaatcataaaaagttaaaggaattattatcaggcagctcaaaatataaggtgtccatccttgtgtgaggggaggcagatggggttgggttggcttataacccagatgtggtcttccagagacaacacctcagggcttgaaggtctggtgctcagctggataatgtcccactcattaagtttgtccatagaccgagacaataaaccagatgcctgtttatcaaaatgggcatatcacttcccagtgaccagagtgcatgaggttccttcgtaagcattgacgccatgggggaggtttttagggaccaatttcacctgtgctctgggaaagcctagtgaaatgttcctgcctgtaacagaggcttatctctagtgaccagatcacaactccatggtgtctcaagactcttttctctaaatcccatttcaaaagcaaccccacctcctccaagttggccacattttattctttatgtgcacaaatgtcaatagtcttctcccactgtgagtccaaatgacagagttctaggggtttccatttccctagcctatacaagtcattttcccactatgtgaatggccctgatattccccactagtcacaaacacacattataaaatgacaatatattccactttattaaccagctgcttgtatccttcagatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagtaagccttcattttgttgtctttacttgaatacaaacatttctcaggcatgtctttttcagtcatcaattcctaagcactccttttagtataagatatcagaggtatctttctgtttactctcattgaatttaaaaaagaatgatgatggctgctatttattgagtgctgtgtgccaggctctgttctaagcactttatgtacatcaactcatttagctatcacaacagttttaggtccaagaaaacattttcatatataatactaacatacttgtcttaataccaacatagtcatgaaatataattttaaatttttttatggaacaagagacccacaaggacagtgcccagggaacacagaagttagaatgtggcccagcccacagctcatgctcttaatcactctatttctttcctagtgtgtatctcactcattcattttttttcatctccttgcttctacaactatctattgggtatcaaccaggtgccaagtattgtactagatggagtgagaaatagcgatacatcagagctatgaatttggaccttaaagaccttattagattcttagactctttcattctgacattattttcccaccttgaaacactgctctttcttaaactttcatgatattgttgagacct

SEQ ID NO: 1741 - DNA, 1750 bp, artificial
  synthetic oligo
acaattgaacaacttcgtattcaaactcaacagtttttatttctgccagcttaagtagctagtgaaactggaaaactgcagcatctttgattatttgggtcactccatctttgtgaaattatcctagtaattccactggagatttcaatactttctgggacccattaaacttttcttgaccaaaagtcttcagaaatttctttacctgcagtccctagttgatttgatagatgacatctaaacagcctatgaaatgttaactttgatttttttttctattataacagctttatcttttaactttctggtgatgcagaaacgagtaacacgacacatcagacagaaattgaacatcacctagtggtatcagttcaattcaggtagttaaagaatccagatgttgtcacctggtactgtcaaacgactctaagcatgtacttaagtttcatttccatagcatctgcggcactttgaagttccactccttgtgctctcctcccactctcaaactagtgtgccaattcaagttcttgaagaccagggaaaattatgtttcttctgccgtggagattgatgctagtcatcttaagtcgtctggggaagaggctcagaaatgtgtgcatcttgtgtcttccacttttattttcccaacccgttacgaagttttggaagatatcttggtcccaaaaacactgacttgacactgtgctattcctctcaagaatctcattaactcccattagaaaggggagtggtgtggactccgtctcgtggtgaaactctctgcaaccccctaacataaatactagagatggggatggttagagggtcaaaggagggggacggaaaagggtcgtgagaagagactcaccgctgctgccagttcctcggtcaggcacaacgtaaccaggagcagccacaacctgaaatgggagggagggtgagtaatgggctctctaggcttcggggtcgtgcgtctgcctgtcgccccccgaacccttttggatgcctgctcccaatttctctgcagtgacagaagtaccagtatagtcccggcctggcaaagtaacccgaagtaagaaagaggaggggagctcggggcagcaacagctcacccagggtgcatgcttgcggctcctccggagctgggtcccgggagactgctaagcggctccgcggcccgtgctcatctgggctctgctgatgcttggaggctgtttccttactcagaacagagtaggtggacgaagtggcccagtttggaagaaactaaacactgcttctagataagaagtgctccaaagggaaacaggctcagcggtgcccgttacaacttgcagcactcaggagatagttccatgcagcaggagaggaaagaatggaggggaaaggggcggggctgtctgctgtcaatcatcccccctaccttgggcagccggtagtctttctcactttcaggcacctttccacacaacagccctaagtatctccacagcttcacacacagccccttagagacctatacgctaagacctaagcaactgtgcatcatatactttcaactttactgttaggttacacataaagagacataggcatactattcccacataagacagatgggcccgaaagtgcccttgcacacatgcccaaatgcatacaacactgattcaaattgatagtacactaggctattgggaaggggagacagtttctggagttgtaaatccactctgagctaagcagaacc

SEQ ID NO: 1742 - DNA, 1850 bp, artificial
  synthetic oligo
ataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagctta

SEQ ID NO: 1743 - DNA, 1400 bp, artificial
  synthetic oligo
ggccaggctggtctctaactcctgacctcaggtgatccacctgccttggcctcccaaagtgctgggattacaggcatgagccaatgcacccggccctagtatttcttttagcctggatctgctagtgacaaattccctcgggttttgtttgtttggagaagtctttattttaccttcctttttaaagagtatttgactatatatattatagaattcaaggttggcagttatttttcagtactaaaggtagcactttgtcttctggcttccattatttcttttgagaagtcagccaatatcttattattgctcctttgaatgtaatgtgtcttttttcctctagatgctttaaaatttttttttagttttcagaaatttgaatatgatgtacctaggtttgatccagattctcacccttttgctgtacagcaagagttagcaaatgccttaagagttaaagcagtgggtcaggtttctgtggtcgccttttctctaacttcttggattctcaaaacctgactattttgacagcttttgatgcctccatatagattgcttttctagtagttccagttgactcactcatttaaatcagacgtgctggatctgaacacatctgtgcccactacctcaatgacgcccgctgtcactttcaagaacttcaggctgaatcaccttctgccagatatggaagactctatactcaccgcaatgttcaatcttgtctgctcctctaagggactgtcggctcacacgataaccaaaacataatagttattggagactcactctatggctcatcttggcacaaaccttccaccgttccaccacaccagtggttctcaaccctggctgtacattagaatcatctggaaagctgtttaaacatatcaatggtggactcctttcaaagactctgaattaattggtctaggctgaatatcctcacctgtggtcccactggcctcagggagaaagaccgcagttgtggggaagaagttggactgcacctgaggaattgtacccattatttcttttttcatttttcttctttttttgagacaaggtcttactctgttgttgaggctggagtgcagtggcatgatcatgggtcactgtggcctgtataaaataataaaacaaatgtctcattttggttttataaaaagaagcaaattgcaaatcaggagactgtgatcaattaaagtgttctaaggtctttctgttgattgggatggggtgaaaatattacctaattttagccttttttgaggtaaatatgcctggtaaaattttggaactaaccactaaaagaacagaaattgaatataaattccaaaccaatagaggaaaaaataattttaaatgaacaataatagcaataaaatcaatccctctga

SEQ ID NO: 1744 - DNA, 2150 bp, artificial
  synthetic oligo
aaatgtgtatttgtctatcaaatcaaaatacttcacttctgttaaaagggtgtgatattatggctatcctcgtatatttattaaaggaacatgtaataaaccacactggtaagtgttcgaatgacagaaaacaattttggtaaagtattcaagtttgaagaaagcctatatcaaaatttaaactaatgttgtgtgtttgtgtgtgtgtgtgtgtgtgtgtgtgtgtgtatgtatgtatactgccgaaagacaaaattacaataaattttattttaaaatgtaattggttttttttgtgattctagaaaacaaagtgaaggtttccatgaactgagcagagaaggttgactttataggcagaaaagggctgaagaaagaaacagtgaacaaaaagtgatgggtcatttcaaaattactttccttgtaaaggttaaaagagagaggactttcttatcacactggctaaaactggcctgtttgggaatttggctattatctctgcctttcttggtttgtcagaaagtcagacaaataacttagtttcgacttggtggcatgaaacttctgcatgagtaactccattttggtttggtctgttggacccagcacaagggctcattctaaaccaatggcctcctataaattttaacagggttcttcagaaaaatttgaaaggacccacatcaaactgttaacactgattataccccagatgttgtataggaagggaaaactttttttttccaaatacatctttgtatataatttaaaacgagcaagtcgtttaaaaactcacttagcaaaaagaaattcagggcagaaagagaacgcaagaaagactgcaagcagcaagacagataggtgaaagagagtgagaagagaagagaaaagagaagagaagacaagcaagacaaaagacaagacaagaaagaaaaaaactgcaatctgtggttgaggagaatgggacctaagcagcgcggagaggcaggcgcgggaagtcagccgcagccacaagccttggagctgctaatccccgtgcgtctgtggccagctgcctgcagcagcctggactggcgggcgccccagttatgtgggaagaagcagaacttcacagtcattgaaaccgtacctaagggaaacagagtggagctctgaatatatatcgatgggagcgactgttgcagaaagcagaccagaaaaaaaggcagacgaagcctgcaaagccaggctgtgggaagtctgtccacccacagggtcagctcgctggtgacgctccagtgaaaggctctggctgcgccacccaccccttgagcccttaagctcaaatgcagcaagtacctcttgtttcaagaggatgagaatctggagggggagggtgaggaagcgcagatgatcacggaggacaggagctggacagaaaaacaagacagttgttctcattccccctctcactgcgccctgccccttaaaggggagtcagtggaaagctcctttctctgctagccttaaggatgggcaggcccgagggctaggaatggggaggaacgttattggcaagagagggagacctgactctgagacggaagagtgtggagctggaaatatcaagccccctcgtcctgccaatcctgacagaccatgttgaggcctttcacgcaatggaagaatttgagcacggcgggctctggattgaaatcccagctctaccacttgctaattgtgaccttggacaaccaacctgacctctttgggtatcttatttgtaaaatgagggaacaataatagtattacccttcccatggggtactgagagattaaagatgataatgcatatgaaatatagcacccgggaaaacgtaattgccaaataaatcctagttattattagaacattaattaatgtgtcatttgtgtgcacagcccgagaccaggtgctgagctttaatagccacagaggctcctagattccatctcttttcaccatctccaagccctccccatttcttcttcctgcccccaccagtgccgaatctaaaatcctatcttgctttggagcgtctccagctgtttgctcattttccaccagcccgctgttacccgcccccaacacataggcacacattctcttggggaacactttcactcagaga

SEQ ID NO: 1745 - DNA, 3700 bp, artificial
  synthetic oligo
aggtgagagatgcttgcttttcatacttgtgggagttgtacaccctagtggcaggatgctgccatacagtgtcatttgttcactaactgctgatcagagccaaggacaattttggctcaagaacaaatgagacctaatgtctgtgagggaagactatgtagataagtcacgggtcagagttgtgttgcgacttgtattgtgtgctagtttcagtaggacttgtgctttcattgcaattgtcagtatgcttaagcaggggtctctgctaatgaaattcgagcatatttgcatttatcgacaggtattactgatggtagaacatcttatttccacacaaggcaatgagtaacattgattatagaagtgtaaacaaagctcaaattcatgtgccaatttgtctatttcaactcatcgatcctcttcttccactggcatgctagcctgagttttatggcataaggccattaaagtattcttcaaaggaatctgttgcagacacctgttcatccctcttctggtcccggtccttgccaaaccagctctgcctttgccaaccaccttgaggtgtgacaggaaaagctgacccaataagggagtcaactgaagggatggagtggcttagatgcaaatggccaaatcccaatggccatggctataaggaacacaggttcctgaagttttcttggcaactagctctaactgctttgccttctgagtgctttggtatttgttttattctaagttcccagttttgatctatttttgccttatggctgcagattccctttctggaaaatggggctctggctgggatcaaatcagagaacacacccagacttggcatagtgcctggcacagagtaagtgctcaacaaatggtagctgttgtctctttttccctgtccaggtttcttctggttctgttctctgtacctccagtattggcccagaaccaggaactgttccctcccctgactggcaagtcagattacctggccctcagacaagctgggctcccttttctggcagccttttgttgtccttacctgttgccatgtgccactcagtgtaaccacaggcagacctctgccaattgctgacattaacctattgaatcctggcagagaagaataagtttgcagactggaatttgcatgtctgggccagatacgagaccaggaggcaaagccatatttacctgttctccccagttgtggcaaatcacccacattctggttaaaaccagatgtttcacacccatgactgcaatgccacacatcaaacagttgcttacaaagaacacaaagtggttttcacatcgcaaatgtaacttgcaggtcacttctcaaatttcctcgcagcagctaccatgcctgggtatttttcccttaaaaatgacaaccttgttgggtctcttgtagggactttcatttggaagccctgggagaacttatatgctctttccaagagggtctctgatggctttaattcacatggagttaatatattggaaaagaaaagagatcttccccaaactcacctgctccttgaaaatgctattctgttgccttggcgaacagccaatccaaacattaaaaaagagatagagaatgcaggaatcctaaatgctattctcagtgcatgtccaaacaagaactgggggctgaggggcaaagaacagaaagaggagaaaagagtttttgtagcctaggccgtgagttgatcccaccccgtcatgtcctgtacccttcacgctcataaagaagacagaggaggccgggcgcggtgtctcatgcctgtaatcccagcactttgggtggccgaggcaggcggatcacctgaggtcaggtgttggagaccagcctggccaacatggcgaaaccctgtccctactaaaaatacaaaaattagccgggggtggtggaacatgcctgtaatcccagctactcgggagtctgagacaggagaattgcttgaacctgggaggttgaggttgcagtgagccaagattgtgccattgcactccaacctgggcaacaagagtgaaactcggtctcaaaaaaaaaaaaagaaaaagaaaaagaaagaggaaggagaaggagaagaaggagaaggagaaggagagaagaagaaggagaaggagaacgagaagatgtggtggcatcatgacttctctgctagggttaattgctcagcctgagaggctctccaggctggcaggtcacactagagccaagagtgaagggtccattcagtaaggtcactgccatgatcagttctcaaccactttaactcagtttttctgttgctgctttgttggttagtggtttgtttgtttctacccatttgggagaagggtaggaaaggaactaaggtgatcaactattccatatgtgtcaggccctgtacttgtcttttcaaacacttattcacactctgagggactctctcaggtccagcaactgtgtagctatgatgtgaaatagcagcttctctctatgcattcactgggaatggtttgttctgatcacacaattttttccagttcttccgacgttaggtgttgcatggtaagaaacaggtggttaattattgagacagttcttatttggaattgtctcttcctccttctcctctcaggcagatgctaaaggatgtctgtagttttttcatggcattttgctaaagatgcacattcattaattcatcaaatagctttttttgagacattattatgagtgaggtgttgtgctatgatatgctttatataccatatcttatttcatcctcaccacaaagctatgaggtaggtactatcattatcttaattttacaatgaagagactgaggctcaggaaacataatgcaaggtcacactcagttaataagttgagagctaggattcaaacccaggtttatctgactcagttacactacacttcctccacatagcacattgtgggcccgtcacagctcttgaggacaaaattcatccttagaaaagttttcttactccactttttgctgatactactgctgctgttgctgctgctactactattactactactgctactgtttctcctcctctatttatccagaactgcatttttccagcactcctaggtgctttgaacccagctaccagttgtagagttcaaacccaggcctgcatgagtcccttgcacccattctacttttctgcactgcttgtaatgtaacacaggaggtatgggacatccataactcaggtaggtaattgacttcaagcttaacattcactcaccaatcatttattgagcacatattagataagcaacctatggctcctgccctggagttgttcataagaccttccaggcagacagctatgggacgaatacacttgaatttattaaatctacctcaggcaaaaaaccaagcatgtaattataagtagtatatcagagtatgtgtaaatggggttctgtaaaatgtttgaaagaggcaggcctgggttagtggtgagaacaaggatcaagaaggctctgccaccaaataacaacatgagtgttgtcccgttaatctctctgggcttctgtttccagatcaaggacctcaaaataatagtcatagtcaccatttattgagtgctttactgttaaccaggcagtatgctaggtggttttcatttagtcttgacaacagtattctcgctttcc

SEQ ID NO: 1746 - DNA, 2100 bp, artificial
  synthetic oligo
gcctgtgaggtgggaacagggtttgggagtactaagggtttggggagggtttatgtgtttattcacccattcatttattcaacatttcttgagctttatggcagatgctgagttgaagaggaagctggggatttaagagggagaagagttaagaggggatccctgggtggatccagatgaaggagaagggaggggctaagtgcctaggctcgctcttgccaggagagcacatctgttaacacaaagctgcatctgtatctcagccagctctcttccatttcatctcctcctctctacccacacttgcaagacggggagccacatggcggcttcctactcccttgtaccactacaccccctgccgggttctttctaggcatttagctgtggcatcagcagcaccccttctgagagatcaggcaatccccaagggtgagtggtagtggtagtggtggggagggttgatagcttcgagagaagagctggagaaggcgctgtctggctgtaattagccccagctgctgttgtgaggcagcgttgggggccgtcaggagtgtacatgcatgtgtatgaacctgtgagcgtggcacctcattgctatcactctatttttcactgtattgtgtgctggctgcagcctcgctgctctgaaacccctcctgtccctgaggatcccgaaagacagagtgttccacaggcagcaccagcttgaatcactaatgctattaagcaggaggacaacaaatataggcccccatatgtcctggatatgcaagtccctgctctctctttccccacccctgcttcctgaatgtttccaagtgagtgaagtcccagcacttgaaattagcaacacctcacttctgcacagccttttggcaaagagctttcacagctgccatgtcatgcatcctcagacgcttctaggagaagcattttataggtgaggaccctgtggttcagggaggtggagagatttgcacaggctaacccagacagtcagtggcagacttgtgtccaggaagcaagtcctcgacctcctggcctggtggcccatccccagcagagcactgccaagagggctgctcccgggtggctccagctgctgctgtctgtgagctcgtgagaacctgtcagctgtggctccaagacctgcctcagtgattgctgaaaacgctgagagtgctgaaaaccaggaccctcaagccgagcctgacgtcacatagttgattgagtacctgctatgtgcccaccactgtgctggtgcttatgggagacaaaacaggggtagtgcatagcccgtatcctcaaagaagtgataacttgaatggggaaacaactcttagataccaagtccaaaggcaattccaagcacttctctctcttccactaagcagtctgttgtcagtgacaatgacacaggaaccccttctgaattcatctgtcttatcgcaggcctggggtaggagaggatgggaggatgactaggaagggtaatgaggaagggcagggagatgggggaaggaagggaaaaactggagctcctaataaacaccaggcacattgtgaagtttatatgttatacataggtcatttgtattatgcttatcatacatgtacatgaatatatacacccaaacacatacacaaacacatacacaatcactttccagggattgactcatctatttggctcactctcaatcatgaaaagagcttaggacagtgacacttttagaaagccctgaatgagtgttaactagcctttcttcttatcatgatcatcttcattgtcattatcggcatattatataaattatctcatttatttcttctaactacaggacttagcaactattatttttatttccagtttacaaatgaggaaaccagtatcttattttatccaagcttgtgggtactgagaatataaagaggaattcaatatggttctaggcaaactttggggtcttccctatctagtgggagggaccgaggcacacataagccctcatggtccaataggtgctgtggtagaggaacgtatctggggaagttgaggaagtctccacgaatgaaggaggcttgagcagcatcttg

SEQ ID NO: 1747 - DNA, 1750 bp, artificial
  synthetic oligo
ataaaattcaggcttctgccaagacaggacttggattatttttgttataatcagaatccgtaatctgcccccaccccagcactcagggctttgatcaaaagtcttccagacaatgaacctctatgatccaagtatcattttctcagagctccttagaaggaggagagctaagaaacttcatgaattaccaaggaccaagcaaacaggcggtagtgaagtcagaaacaaattcctcccgagactagttttgtcctatagcctgaaaacaaatccggtctccaccagacataaggtggaattcctgtcttgattttttttttagcactgatattaacatttttcttctcaaatcctcttcagaaccagcccttttagaacacaaattagaagctgtttattttgtcaatcagagaaactgaaggcagccagccttggccaaaggaacatcttatcctttgcctttgctaaggacaatgttccttctattgtgctctgtggaaataaaagggcaaaatatgcttgccttcttttattcttattcatggctgagggtcatatgaaagttcagagaagagcacagtttttagtatgggtcgtggcaggttttccagatggcttcctagccaagatatttctcccgctcacctccaaacaagttatgtacccctaagaatgatttggtctcagtgttaggggaagagggtaggtagcagggcctggctttgtcatcctgggctattttgaggggacttcagcagtccccgacagaaggacaagaggggctgattctccctttgtgagcagccattggagctgcttcagggactgacaagccggccagagacaatgtcctctctcaggaaagcagtaaaaacatcagaaatgctcctttcctggggagcccttagttattttggcctctctttccattaaaataggaaagcattgaaagggaccattcgtgggatagcgtggagcctccccattgtggcagcatttctaactgcgttgagaattaaccatattgctcttcctttttaccatggaggagtttctagatttttatttataccctaccgcttaaaacatctttcactgtttcagcaaattgcagcataaaagatggagaagccagcaggggctgtgctcacaataatagctgtggttgcatttaagacattcaaatgccaagggtgcacttctcccattaagtccaacataagaaatcaggtgtgcacaacattgatgaacagaagaccccaaaggacaggtggagtttctggtatgctgtggtgggggcggtggggtggtgagcttgggaaagaacgaacaggcattttcattttccaaactaagaagcagtttcgggcgaaggggagccgtggggatgtcagaaattcttctaacgccatggacctgcccacacctgagtcagataaagatgaccttccctaggccctgctttcctctccccctccccaaaagacagcatgagcatgagtaagccgggtacttacaggtgcagaagaatttggaacaggaaaatggagcttacaggctcccgaatgcctgccgagtcagttgcatcagattaggaagtgatgatcctaagaataagatgtttggaaaatcttgtcccccgaaagccccctgctttgtcttctcagcccacatccaaactcagaccacccccaggatgtctctcatcctgccagactgcctggtgcctccgtgccccttaccgtgaggg

SEQ ID NO: 1748 - DNA, 1650 bp, artificial
  synthetic oligo
cttatctgtgttgataccttaactgtgagtgattccctaaagcaggtccttggacaagtgcccatcctccaggaaaattgcagcagtccaccgtgcaatgagaaagcctgaggactaggtagtaaatgtttcgcagagaagagaaatctatttcatgtattattctttattctgaggttatttccttctcttttggtgttgaaaggaagccccttctttttagaaaatgatgatttgtggttgttctgtttcttaatgattttacttgggaaaataaaaatctggaagttcaatatcagtccctgaaattttgggttgcattagctgcaagtctgggaacctggtctaattttgagtgttctgctagtacctctaggtacctcctattgccacttgtgttctaagtgcttataaattacctgcttcgcaatctgcagcagaatctctccgaggattgacatcaagcttacagctttggagtttacggtatactggtctgtagtttccttatttaagaaaattgggacactgcccatttgcagtcctctggtatccctcctgttctctctgattccacagatccttcagaccggcacctaatgcaaggcagttccgtttgctcttcttataatgttcttttccctatagagttggacatgcatatacatgttgtttggggaatttgcagcacatccaatgaaagcataattcccaactaacagtcaaatccttttctttggagctacccagaacacacctaccctctcttccatatgacagcccttcagagacttgaagacagtgtgtgactctcctgtgagttaagagcactggctgagtcagacagacccgagtgacaagcccagcttcgctccctctcagcggtgagagccaaggtaagttacttcattttaatttctctctagttcagttctttagctgatttagaaaatgggagtaaaaaagccactttgtttgtttatcgttcaataaataagatgaggtatgtaaagtgtttaacatagtgcctggaatagtaagcactcagtaaatgctagctatttccccctctttatttataaagagccggtgcgcattttaagtgtcagggctgtgggggaggaaggaagtggggagggcttctacttccctgaatgatcaaggaaggaagaagatcctaaagtagaccaggtatttctttagccttaggttgtctgttttcagttatctggatgcctatttgctaggacttggggaaagaatattgttgagaatctagggaaaggcttattttcaacagctggaaagctatttgttgacatattgaaccgtctcttgtttattcttatttccctgagcagctagccatgcaatcccctaaactcaattaccttttgtgaggcggcaggagcatgacacctcctagccgtattgatcagtgcagactgggtgggacgtgagggacctgagagatgctaagcggtaaattctgggcttttccttccttagaaggcctctcttctctgtgttcctagagactctggctttaatagaacggaagtctatgcctcacatgggctgagcatgcaagaaccctctctcagtagcctccttagaagcaggctgatgaaaatagtcacaatgggtcag

SEQ ID NO: 1749 - DNA, 1500 bp, artificial
  synthetic oligo
ctctgagtgcttattctcaaataagccctgcctcagttgcaaggtctttcatctgaagatgacctatcttacatgtgtgggaatacatttttccatgattacttcaacagctgcattctgataatctgcctggggaataactgttgatggataaaatacagtcagctcatctcgccagtgaataatgtgctttctggttctaccacgtgaaaatgaactgctcagatcctcttcatctggaataatttccagggaagaatgagtgactgaaactgctgacactttcagaataaacccttgatgtctttgacaattgctccaagtgatttgttttgggataagcttgcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggggagtacggggctcaaaacacccttttggagaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttctttttttttttcccaaaagagtacatctgatcattttagcctgcaactaatgatagagatattagggctagttaaccacagttttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaact

SEQ ID NO: 1750 - DNA, 3000 bp, artificial
  synthetic oligo
tcaaaacatgtgttgggactgcagcagtaaacactagcaagcattgctcagcgaacttagccgactcttattcttgcaaagagccaaactgtccttaatttttcaaattatactttgacccagttaactggagttatttctgcattaactctctgtctgcttcacacaggctgttgtgccattgaacttgcactggctcttttacaggttacttagacatgtagccattgacatgcttcaggggatccaggacccaacaagaaagcaacaacaacaacaaaaaaacaaaaccctgcaactaacacaggtagtggaggtgggatgggagagttcctgtgttttacaagagaaagagaaatgtatcaagtaccaaaagaaaggtatttattaaggtgcttccatgaaacaagcattcacattgttcatctgcgttaagcaaagggaccaactgctccttgcccagctgtgactgcaaggcaatctgggccatcaagtgtcaggagcccactttcagaacaggtctcctgggtagaacagaagcaaagagacatccccacaggaaggctaagggatgaacacatgtcagccagttcttcacgccccacagtgtctctttaatcctcctgagaggcttgactgaccttgtaatctcacattgactatcatctgtgggacagcccctagggtagcaattttctttccgacaaacaataagaaagacactggagtcccaggcccttgtccatcagctgaaatcctctccccactctaccacccagcaagaaaagttcagttaactggtggtgtgttgccactgaaaatggcagttttaacccagggtatctcttgttggaggaaatgctttcattgctgcttatgactgacaaacaatgcctcgcatttggcttgcaaaacacctttctatcatttcatttcattccacacaactccaccttcaaaatgggcactggggggacccagagaactcaaataactttagtggcagggctgggagggactggaaagcaggctttccgggccctatgttctggcaatataccacgttgcttccagagcctagtgtctcaaattctgacccccgtagtcagggacaaaaaatgaggcagatggccagaggataggatagggagcctttcgcccatctaccctgctacattaactttaccatgtattcatcagcaaaatgagaaaacaggctcaggaatacaggcagtgattaaggggactgcagagtcccttgggtagctcagggtggagtacctaagtgacctctcaaagcgccagagcataaagaaatgcaggccgagtggggagggacgagctgtgagttcgaattcagagacccccaacttgctttggtcagaagccttgggccccacctccatccaggttgctaactgctggagcacagaacaggttggggtggcaggggaatttggggcaccctggggaaacttccagggacggctccggccaagagaaggcaacccacctgtgcaaaggctggaaaaggaggtgagggaagcgggcgccgggcactgctcactaacctgggcactggccttctccgtctgccacgcgtgcacgcgctccgagctccccggggcgctctcgtccgaggtctggggctggcaggttgtggcgagagctagagtgcgcgcgaggggggagggggaactcaaaagtgggtgggaggaaaaacatcaccgccctcacaccacgagggagcagcggcttgctcggctcccgggggcagagccaaggcgcgggcgcggcggcccggggccacctgcccgccctcccgctcgctccccacttggcccgagaagccggccgctcggcgctggcgggaagtccgcaagcacgcagccgctgcaagcacgcacactttctccaccccggcacaatggctttatttctgctcccccggcccgaaagtttaaaaatcgggagaaagtgtgagactcagccggctactttcccatcacacagcgcccccactgcagcccccactcctttggctaggcgagcgttggggtcttaaagggaccgcacagctcctccggtccctcctccccctctgcactggatgcacctaggagctccccaccactcgcgcacgccctgaagataccgactaccctctgactcccctgcctggaagcccacacccgctctcctccggcaccaaggcctttccgaggtgtgcacctggtctggtactgagctggtgccctggacacagaatgaaccctcctcgcaaatcacgccctagcatgctgcttatcatttcacggcgtttcccatatccacactgtggctaacagagtgacaaagctttggtttggtgtccttaaaggcggggtggagatgggtgtgtgtagggtcagggattagaaatccactttctcttacaaactgggctcccaagcctcatggaaagggcctgttctaactgttaagtgtcttgaagaaaacttggtgccacacactatacccaccattttttttttaaatgagtccctaagcttctaagttgggccaagagctcaacctggaaatcacagtagcactgctgatgccttggtgggcctgcctactccaaatttgtgtttattcaacaagtgatagttgcaaagaattgtcagaaacttctagggtccaggaaagtgctgcctcgacagacaaaattttaagcccctaaatttggagaagaaccgcagagcttttttctagatgaactagataaatatctatattcctaacatctgtatagtactttatggcttacggagtgttttcacatacatcaacattactttttaaaccctcaaaaccaaccgaactacctgaggtctcaagtgttagagttggtggggaacttctgaaccattcagcttaacttcatcatttcacagaagaggaaactgaattgggggaagaggatgatgtatctaaggtcacacagctagtaaatga

SEQ ID NO: 1751 - DNA, 1550 bp, artificial
  synthetic oligo
atatacacaatggaatagtgttcatctataaaaaataatgaaatcatgtcttttcccacaatatggatggaactggtggccattatcttaagtaaaacaactcagaaatagaaagtcaaatatcacatgttctcagttctaagtgggagccaaataatgggtacacatgaacatggagtgtggaatgatagatatttgagactcaagaaaggtgggatggtgggaggtggtggggtatgagaaaataatgagtaaaacatacattattatcattattatctttatggtagatccatttagatggacatattaaagcccagacctcaccactatttaatatatcgatgtaacaaaactgcccttgtgtcccttaaatttatacaaatacaaataaatttttgaaaagattcagcttttagtgtcaccagctgtagatccctgaatccccaaactgagatgggtgccccatcctatgcttaccctatcacagtgttatgatattgttatagagctttttgtttgtgcgccagtctctccaactagattgcgcctttcttaagagagtcaggccctttcaacttcatctgtgtatccccagcacctagctcagtgttttcaacacaatatagactcaaggggtatttgaactaaactgaggcgacccagctgtactggaacaggtttaagcttattttttaaatgtcaacaagttgccacagacaagttatctttcctgaaatctcagcatggaaaacttctggacatttttctggtggcaggaaagatggttaattcgatctaggactcatgaagaaaatggcattaaacaaagctgacctactactctattaaaagtttgggcaacactgccatctagtgatggaatttagatatgcttgagaatgagatctgtagttcttcatggaagcctggagaaaaccactgagctttcgtttacacagagaaagaggaatggctagtttctctgaataagacatgtagttatgcgatgtacatttcactcgatagatcgtgttaattgagggaaataaaggtctaaatatatcatttgttagccaccaagtcctattaatgtggctagttgctgatggggtgggaattgcacaggacagtccagatggaacctatttgttcccattgtaacattcagcatcagattatgtaccttatttttttcaaaaggaaaatatggctggcacagatctgctttcaggcattatacaatctaattggacacaagaagcaattaaggaataagacaccattaaatttgactcaggtcattgattggctgtgtgtgtgttaaacatatccaaatgtatgcatgagtgttttcagtcattcaggtggtgggggtgtctatactttttgtaggaatcctcaaatagttttggaatacactgcccttggaatcatcctgagcctgttctaacacgaataagaaacagtagatgtaatctaccacactgcaagcagctgaatgtgtactgcatttggagtcaaacaggttggagttcagattacttgtc

SEQ ID NO: 1752 - DNA, 1350 bp, artificial
  synthetic oligo
aggtgatccgcccgcctgggcttcccaaagtgctgggattacaggtgtgagccaccgcgtgtggtcatctgtagctcttttgtacgacttttactaaaaggacctgggcagatatattagttcactcttgttcttgaaacctattttgttggcattatggagaaattattgctggatgttacacagtgtggagaaaattgaataaaagttcactgggaagggtcatgatctattttggccatttaagtatgtgaggatatatttatctttatgaaaataaatttgaaagtagaaagaaaaagttactcataatactactagtttaacccaacggttacaattttatgtcctcttctgatcgttttctgtaggcatattttacatcattataatttgaatgtccttattgttttgtattatttgactttttatggcagcttactgtcgccttgctgggattcaccataatttacataatctagccaaatcatggggagtatggattttggagtagcaagagattatttttggagttagattttataaagctttggccatctgcaaaaatttgaaccgtatcctaaagacaagagaaagctttgaaggtttaagggaaaggatggacagagagaatcgcatttaagctccatttgaagtagagttatttttattttttgtataattccttgctttttggaatgtgtgtgcttcatatgcagaaaagtagtttcccgatctagactgccatctctttgaattccactgccacatctgtctctcttagttttctgtgtattttagagattccgtcagtttaacctgcctggctgacaggtggtgtcccaaatcgaaaccgttttttcccccgaataaagtgtgcccgtgtagctgtacagatttcgtcccctgaaaattcatctgaaatctcaattctcctgaggggagcaattaaggaagatacatgaactctcccctcctctccatcctgtcaggtgcccctcttttttgatggccccacctctgtctagacaaccctgacagtgtagaagtttccatctcctttccctttccctctccatgttccctccccttcagttttttccccctcccaggcgcttcctgcctggaaacaaaagattggtccccagtagcccactcagggcgattttagttttatgctcaccatctgattggcctaggtaaggtgcagagctcgggtgacgtaatagcagagaagggctagggagcggttgccgagcaggggctctaccgcgggcgggcagctgtgccagctaaccgtctgggatctcgcactgggggctgcagcttttccccgcctcgagccagtgt

SEQ ID NO: 1753 - DNA, 1400 bp, artificial
  synthetic oligo
gtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaacttaaatacttcaggaagtgtttctaaagattggccaagagggtcgctgaaaaaaaaaaatcacttgattctttgcctttcattcaaaggcagttttactgtgaaccagcaaactaatatacagtctcccaaacaagggaggtctatgttgtgattaagccgtcttccctttggcatgagggtgagtagaatatgtgaccgtggataaaactttgggggcatttccctttttttagccaaactgcagtccagctgagacttcca

SEQ ID NO: 1754 - DNA, 1550 bp, artificial
  synthetic oligo
tgtctgtttccctggactgtactatgagcttgagagcagaaaccatattttagtaatctttgtattcccagcatttagcacagtaccaggcaccaattgtattcaaaatatcatctcattgctctcatgcttgcatgctctctctctctctttgatggttccacttgctactccaggcccataattctcagcatttcctcagaatatatcttttgtctacacgaattccctggattttgactgtctagtctctgctgatgactccaatttacttgccatattcccaccagcactccaatgtctggcttgctatgatctagcttcagaaaggctgccacctcctcaaatgaactctgtccccaaattcaacttttagtcgaccctttcgaactaccttctttcttgccaaaattgtgattgaattgcctagcaaaactgcttccatcatagtacattatgttgtgttgggttttatattgttggagttcaaaatgctggagatcagagctctattgctatatttctgagtatcatggcaaatatgcacagtaaattacaggtaattattgcacataatccaagtaataaagaaaatagtattgattgaaaatgtaatcactatgcctacttcctcttgctggagccctcctctaattattcgatttcctgatgctccactcctttgctctctttcattttttcctcctttgcatgcctttttcatcttatatctctcacagctctagccttatctcctcagtctatattctttcctcttcttcattttctttcctatacaaagcttgttttaaaaggttctactccttcacctagcataaccctcctaaccctctggctccttacctcacctttcaaaataaaaacaaacaggcaatttgaagtcaattgaacatttcaggaatgcttcccatgctttgtagctgtagatatgagtaaaaaagattgtttgattcagcaaatatagttggagtaggggttaggagtggcagtttcaaagattgcagattaggtaaaggccatatcatagtggcttaattaaggtacaatatgttctggttagggaccagaagaccgctactgatggtcattggtcatgtattgaaagtactctgatgcatttgctcagtcacaactgcttccttgaacatcacttctcaagttatttggaatgagtaaagctgatttgccagattcattttctgcaattaataaacataattcagtaagctagataagatggatgtagtcattagaaagaatggcatgaagggcatttattgcatctgattcttaaactcggcaataaaacagctttatttagaataaatagaaccccagaggctgatccgtttcctatttttcatatttatatggttctctgggaggccacaaggagctctaggattgcaattttagccctcaaaaatagcatgagagatagtaagaaaacttctggggataacacagagggtggtggtattcaaatgagcacgtcagacttactcctttccttaaaactccaagataga

SEQ ID NO: 1755 - DNA, 1700 bp, artificial
  synthetic oligo
aagagagacaagttatgggaagatgagaggaggcaatggatgataaataagggttgtcttgttatgcagataagaggctttcaggtgacaagagttgtctcctgaagagtagctcccttcctggtaagatacatctttacaaatggaaatttccattacaaatatacatttcttttataaaaatgtaaatctatattttatttttaggtagttaggagaaggtaaagagcttttcttgcctgtattgattctcaattgcctttagctcaaaattatccttatgccaaagcggcataattttgggtggcatattctggtacctttcactccccacatcccacatccccatacactgctctgaacatccttaagtagatacatcatggtcagaacaaaaaccatcaactgtcatgatattaagtattttagaaaagttaggtgtgtgtgtgtgtgtgtgtgtgtgtgtgtgtgtgtgtgtagggtgagtgaataggagagagttattcatgaaagatcactgagccaggattaagaaagcatgctttccctacagagactaccagtgtgttattatgtgaactcaggctaatgatttaatttcttagttcatttatttctcttattaaaatcggaactgactatgcctttctgcaaactagttaactgtacttgctacagcactaagcacaaataaatcactcattaatacctgtaggttaatggagtgatccatggggaagttacatgtggaaatgatgagggcattttaaatccctaggataaaagcttccactgcatttaatgtaaggtactatacctcaccatagtactgtcttcagaatcttatatttttagcattttagtaatgaaacctctaagaatgagagtcatgttcttttcaacattttagcatttcagtctaatatggaagcactatactcaggagtcagcttaggagacctgtgcaaagaaagtcggacactgagatgcttttatgctctgctttagaaacatatctcatagcgagataaagtaataacagtaatttccttgtgtgactcataaactgatcctggaggcagttgcaagaaagagttctacatattgctagaataactgcatagcttctgtaaccatatttactggaccccaaatcacaacacatagtttgaccaaggatttttcctgatttataaatatctgtgaaaagtcttacaaaattattaagattaagtaatatctcactctacctttaactaatcacctttattgagaataataaaattatagaacatctggattgtctgtcctggacaatttggaactgataattaccatgtgtacagccaaaatgattatcttgaagaggacaaaattcctttaaatgcaattaggcttgcatatttatttaaacactagtcttactctcttacagtcgtaccttgtattaaagtatataagatgccctaaaaagagaataatcaccaaatgaatctattgctttcttcccctgagttaacagattgctacaataggtaataattccatgttcctctgtattagaaaaaggtagttactaatagacaatggtacagttgttatttaaccacacctatataatcagacaaaatggctcagtgtacatctctcatttggcataatagtgatctttgtcactgaactttagatatatcaaatga

SEQ ID NO: 1756 - DNA, 1700 bp, artificial
  synthetic oligo
ctgaggctccaagctcaggctgaggctgcaatatccatttccttaagtataagtcaaagtggtagctctgatttttagacttcagacagtttttgtgtggttttgcagtaataatctatttctcataccctaagatgaagcaatgtaatgtgaatctccttcacaatttatttttaagatgacattcactactaaactatcagtttaaattcttgttcgtggtaaaactaggagacttactattttcttaagcagttttcattgctggaatttaatgtggcaatataattcctgaatggctcaatgatatcatgtaagccttctgctaagtgaagaatgtgaaatgctgaatgaaagctttctacaagcaaaatgatttgaaagataaattcaccttaaagacgaaaatgtgttctagctaagtagaaagacaattgtcttctcatcaggctcatatcctattatttttatttaaaaatgaagcattacaatattattaatttgctgctttagtgataatgaacatttgtggacaagattttggggggcattcactttcatttctcttagatatatacctaagaatggaagtgctgggtcatatggtaactttatatttaacttttttgttttttattgaggttaaactcaattaaataaaattcatcatttcaataactttaaagtatacaattaatcagcttccagtgcattcacaatatggggcaaccaataaccatatataattcctggacatttttatcactgtaaaatgatatcctatacccattaagcaatcattctccatttctctctgcccctattccctagaaacaaccaatctgatttccatctctatggagtggcctattctggacatttatataaacggaatcatacaatatacggcttttagtgcctggcttattctacttagcaagttgttttctaggtccctccatgttgtagcatgaatcagtactttactcctctgaatggtaaaataataaattccattgtatggatatatcacattaatggattaatatttatgaagccattgatagacatttgtattgattctactttttggttatatgtgaataatgctgctataaacatttatatacaagttattcaaacactagttttaaattcttttaggcatatactgaggaatgggattgctaacttatatggaattatgtttaaaatttggggaaattgctacactgttttctgcagtggctgcatgactttaaccatgcaacattgtatgagggttccagtttcttcacatccttaccgccacttgttattttctctgtttcatagtacccattctaatgagtatcatattgtgttttaatttgcatttccctaacaattagtgatattggactttttgtgctttttttttttttttttttgacagggtctcactcagtcacacaggctagagtgcagtggcatgatcacagctcactgcagccttgacctcccaggctcaaattatcctcccagttcagcctcctgagtagctgcgacttcaggcgcatgctaccacaactgactaatttattttgtattttttgtagagatggagttttgtcatgttgcccaggctggtcttgaactcctgggctcaagacatttgcccgccttggcctctcaaattgttgagattacaggcgtgagcc

SEQ ID NO: 1757 - DNA, 3000 bp, artificial
  synthetic oligo
ccaaacagaagtttcacttacagagactgacacgatcagagactgccccctgccttcctacacagcacacagagttctactgcgttatttttttattaaaaataatcctaccaactttaaaaagactgtgtataataagctatctatgtctaagatttttttctaagtctatgaccatgtttgaggcacagtaagggaaaagtcaattgtgttcgatgtcataaaagtttatttctaggtgtggcatgcctcaacgatggacattatggatctgatgctgggtttttacgattaagtagtaatagcgaatgctgaaaatataatttgatacaattgtattactaccaaaaacatatctggctatgataatttgctttaaaactgaaaaaatatgggtagaagtattatcaaaattccttgcatttatgtcctgtggtaaataagaaaaaaaaaaaaaactcccggtagaattcttgtgtagcttcttttgatctgtgaaaatacctgccttcgagaattttgctagaatcctgtcactcattttttaaacctgtctgtcatcctttaggtgtgttaaaatagggctctctggtcaagagggggaaataataatgagtagagaagtaaactttctagtcagtttatttttttaaaaagttcccaaagtttcaaatgatgaggaactttttcctacgtagtaacaatcttctttaattctttcccgaatttctaaatcagtagttttggaaacatatgtatttgtagtaggaggaaatcgccccggttcgaaagttgtaaaaacaagtccacagccttagaaaccgggaaatatttggaaaccgtgttccggggggcactggggattttaatcaaacctgaggaattcactgtaaataactcctctttccagggacaatttccatacacctgaggaacggaaaggaaagcagtgaaaaccctgggctgactccccaggcctcgttaggcaggggttccagaaaacctctctggcaatgacagagcgacagaaagcgccagcatgtgcttgttttgagtttgcttccccagtcctaaagtgcgccctaaatttctccttacactaaattctctggtctggtgttgccaaaatctccaaagtccgtcggaccttgcagcgctctgccgagccgcagcctagagaacctgaagaggcagtacgcgccgcaaatgccaagaaagcagagccttcggtcccggcggaacccggtaccccgagcctcgccgcggaccgctccggctcagtcttacaggctctgggccgctcggcgagcgccgctcaaaggctaacgtgcctgcttgtttctacccgacctccgaagcccagacgtgcttcagcaagccgcgtggctagcaaactttctctctgctgctgcgggaaccttcccaacgaccacgtgggtttcacccctggtcgctctcggcacttttgcctttcacaaggagaaggagagaacagcctttagagcgaaatatataataataaaaactattattaccatcatcctcatcctcataattgctattatcatggtcaatttctccaagccggttcccccgggagccggggagcgagaacaggttttggcggatgctaacttccactcgctgctcggcagatccattttggcttagcaaaaatatcacagggatttatatttacattttttgaagtaatataaatgtctcagcctctgacaaaataaatacgagtcccgccagaaaaggcaagactaagcattccacattcatagagtaaggggacacttggggagtttttaaagatgagtgcttaattatttaaagagaagacatacgttttctcttccatatttataaattactgttcgctaccaaagcatttctaaagatgcgagcgttgtgcagtcggtggacttggcagcgctgtcgcagccacctgtgcggcatcatacagcagcattcaacagatgcttcaagaaaactgcgatgggtttttgcttttcgaaacagaacttgggtgccgacagtatgttcactgccaaattaaatttcaaagcctgaattcagtggcgatggagggaatcagaggattcccaaaatgccccttttggaatagactggacagctcctttcacaaatatggaaacagaggcacagagagaaatgactgttcctagggcatccagaataaggaaggggcctgacccttatcattgcttccacttccttctccatctctaacttttggggctactgaggcaaacttcggccttcagaatagccggcagctcccaccccttttgcgttctgccgggttaggtcctccaagcctctctctgtacggcctctctgtagcctcttctatacactcgctgcgctgccgtccggtcctaagtagccaaaccggaggctcgatcttttgcttcggtccagctacctccgacaggcggggagccaatctccacttttcccaccccggtcctcggtacagggccgagaaacctcggccgcgacccgagaccaccacccccgctcgccccttcgttccctcttaggagagatctgcttctgtccccattctccgtgggatcatctccattactcagcttggttttggtgcctctgagccaagggggccccgttcacccttctctgcgctgccgccaggacaccgcaggcacctgcccggttgcgcctgggagcctgtgaaaaagagctctgcctgaccggttagagctctgcctgaccggttgcagctcggcatcccagcagttgccaaaagagagcctttgtggttcacctcttgctgccttgaccttgcattgacagcacccctccctcccccacaacgactgggcaaccgactggctgtgggcccaaggccctgtgccagagagatatgttcacccccttggaaacccgtaagagctgccctcaagttgtctttctaatgaggcctgtggggtcaagaaaggaactaaa

SEQ ID NO: 1758 - DNA, 1500 bp, artificial
  synthetic oligo
ttatattttaccaaatataaactatcaataatgaaacaaaaattataaaaagcccaaatagaaattaaggagttgaaaagtacaataactgaaatgaaaaattaattaaagtggcttgacagcagaatttagctagcaaaagaaagaaacagcaaacttgaagaagaaagttggaagactcatactttctgatttcaaaacatactacaaacctacacaaattaagacaatgtggcactggtacagagttaggcatgtagatccaaggaacagaattgagagtacagaaacaaaatttcaggtcaactgatttcaacaaaggagtcagaaaaattcaataaggaaaacatagccttgtcagcaaatgatagtaggacaaatgaatatcaacatgcaaaaggatgaattggaccaacatacacaaaaataattcaaattcaattatagatatgagcatcagagttaaatctataaaaatcttagaagaaaatattggagtgaatcttcatgaccttgatatgacaccaaaattacaagcgataagtgattgattacagtttgctttcatcaacattaaagatgtttgtaattcaaaggccaccaccaagaaaataaaaagacaggggagataatttttgcaaataatataccttataaattttcatttgaacacctattttcaattctcttgggtatatatctagggatatatagtagaatatataaagaaaacttacaacttcacagtaaaatgatatgcaactcaattaaaaatgggcaaaggtttcaaagaggcatttctccaaagaacatatacaaatgggcagcaagcacttgaagagatgttcaatgtcattaggcattagggaaatgcaaataaaaaacacagttatatagtactccacacccactaggatagctacaatcaaaaaggaaaacagcaaaaattgttggtaaggaagtggtgaaattcaaaccctcattcattgctggtgagaacataaaatggtgcagccactttggaaaagaatttggcagttcctcaaaaagccaaaaatagttaccatctgacctaaaaattctactcttaggtatgtaactgagagaactgaaaacaggcattcagacaaaaacctgttcataaatgttcacagcattattattcataatgaacaaaaagtagaaacaacccaaatgttcattaaccaatgaatggataaacagcatgtagtatatccatatgccagattattatgtagccataaaaaggaataaagtactgattcatgctacaacagagatgaaccttgaaaacattatgctaagtgaaagaagccagacacaaaaggccacatactggaagatactatttatttgaaatgtccataataggcaaatctacaggcatagaacataaattaatggttgcctggggctgaacaagagttagagagagaaagggaaatgattgctaatgggtaaaagtttatgtttggagtg

SEQ ID NO: 1759 - DNA, 1600 bp, artificial
  synthetic oligo
tcctctccccactttgttccaacacaaataccttgatttaagatctaaaaactgaatacatctgaaattgtcttgttttgaaaataagtggtattttactactcctcattatgggtgaatttacttactatattgtttcaaaatgacgacatctattaaaataattttgtccagatttatttcagcaaagcagatgaaaacagaaataaataacaaatttaaagattataaaaagtaaaaaaaaacctttcatcaaatcaagacatatctaaaataatccagcattggtttataagagagtgtgtccctaacaaaaaatgccagccacaacaaagactaccagagagtatatgaagaacattacaatagccaatttctcacccaaagtgataaacctttaatccacaactccataaagaatggagataattttttctcaaaaatacccttaaaattgttggctttctactataaaaattaagactctaagataactcaaaacaaggattagctttcttctagtaagcagacatgtaagtgattgatgatttaatttaccactgcagcaaatactaatttaaccaccactaccttctcaacaccaggaaaatgaaaaatctcagtctttaaaggcatacgtgacaagaaagaagccaagaatatcgtaggatgattaaaccacacagaaaaaccatggcaatcctgctgctgtactctgaaaaaggatatgccattctttcaggcacgtatgcctttaaggaatatgtagagattatgatttttgtgtttcgtttagtttggttgggtttggttttccgggaaagacgggaagatccaggagagttgaaagaagtgcattaaggaaggtgtcaatgactccctcccacccaaactggggaaacttgctttaacaatgatgctctttcacccctaacatcctaccagtttctatacatccttcaggcagcattcctcccctcccctattgcttgattcgcccctcacgttcaggagaacgggctgccccgactttgttagtctggcggtccccgcgcacccgcccagacccgcagagtccaacaacgcagccacgcagccacccactccccgcacctcctccttcacagccagcttcccctccccccgtcctgtcacctgcttgggtggtgtccgtcaggtcgtagccgctgcccgggaagtctcggagtttccgaccactgaggctcaggatgccggagctgcccgcctcttccagggcccggtccaggctcctcacggtgtgctgaggctgcaggctccccgggttccacggcggcccgttggggaacggctgaccgaaaagagtcggtaccgggatggggaccaccagggtcccgccgccgccgccgcctccccctccagccccgccacctccccctccagccgtgccacagccaccgctacttccacctccaccacaaccgccgcccccactgttaccgcctcctccctgactcgccgccatgttcctgggagagagaatagcccccgacaatactgtcagcctgtgccgcgagtgtaaggggttcttaggacgcatgcgcagactgggggcgggggg

SEQ ID NO: 1760 - DNA, 1900 bp, artificial
  synthetic oligo
tgtgaagagaaaaaaaaaattccacaacatcttcacagtcaagtttttaagcaacccgaatagcttgcatgattcccatgagccttgggaactcaccaggctattatttttaaaggacctttatttgcatctcccctccccttagggaacaaggtgctgggaggatgcatgccccaagttaacactcctcagagtactgtcatcaacagattatcttcattttccttaatacgctacaggtgtctccattctgcaagagcagcaagtccctttttttttttttttttttttttgagacggagttttgttcttgttgcccaagctggagtgcaatggcgcgatctcgactcaccacaacctccgcctcccaggttcaagcgattctcctgcctaggcctcctgagtagctgggattacaggcattcgccaccaagcccggctaattttgtattttcaatagagacagggtttctccatgttggtcaggctggtctcgaactcccgacttcaggtgatccacccgcctcggcctcccaaagtgttggattacaggcgtgagccaccgcgcccggccgcaagtcccttttttcaaaagaaaatatcaatcagaggactggtcaggcaggggaaacctgcgagtcgctgtcactccttcggcctcagcacatccccacccacctaggcggcatacgcgccaccagcagcatcccctggaaggctgcagaagcagcgctgggcccctagcagttccagaaaaaaagtgggaggtgacagggcaccggcagtgtctggtcttgggaagacgcctctcacctggggagggaacaattgaagctttcaataacgtcaggcatacagatgatacaaacttataacatcgcctgaaagtgtacttgcttaagcttctttttcctctaaaccgttttgtgaatgttaaacagtaaacttttcattttctcgatacatcagtctcctttgccctcttgccagcgaagaccttactcaaaggaaacaaatgggacaaataggtactcctcagcaattagctaagacaagaggtttcccacccaactttcccaaagctgcctctctccgccccttcttgcaccaggagcaggctgaggacaccccactcctaccctgggcggagccggctctaggaagaccggattcctctcccttcccctccccggattctttcagccctcacctcccaggaatggggagggggcatcctaccccatatctgaggtgcgactgcgggacgtagagcggactgggcctttcccgttggcgcgtggcctcaatcaggtaggtctccttcgccttttctttcctttatttgcctttcctttccttgacacaggacacgagatcagggtttgtgccatgggcagcctttctggtgcagaggaccttccctgccctccggcttctgggcagccagtgccgggcgcgcgaccttgtgcaatggcggctgcagccgagctggctccagcgtcctgcaggcatcggagggctttcgggcgcgttttggacgccgagtttttgccgctgcctaagttttagttctggcaagtgtagggaggtccttctagtagagcctttctggccttccccgtcgggagcctggaagcgtctcctgtggcagggcgggcagagggagaagggtgcgcctgcagatttcttcgccccactggtgttctccccacctacatggctgaggaggtgtgcgctctcgttcggtttagattgagtggttgttaaaccacgtggctgccctgcccacaggcagggctccccgtaatgtaaaactgtagaagaaacatttcctctaacgaataattgaacaaaaagaaatacagcttcaggccgggcgcagtggctcacgcctgtaatc

SEQ ID NO: 1761 - DNA, 1000 bp, artificial
  synthetic oligo
tccctagttgatatttactaaggctatttagtgaaggaatgatctcatcactttcagtaaactgtagcctagactataagcctccaagaaaatcattagtcaactgtaattaaacaaacaaacaaacaaaaaagtcaaaatattcagagctgaagacattcagagctaagttaaaagcttcgaggaagaagaggagtgtgctcctgacttgggagccagcagaggagcctcctaagttagaagattctgaaggagagatggattaggaggcacaaagcagaaactgttagagggcaagagacagtagggccggggcgggcagcgggaccccagaccgtcagggcagcaacagcgaggcccagaggagaagatcttggagagatgacaaagaagcacaggaaagccgggttctggggtcctagaagaacccaggcgtccgacggagccagagggaccggcagaaagggatgcgaaggtgtaaggatgagggcgcgcaccagcacgcgggagaaaaagagggggcggcgggcaaaatgaagctgtttccctgctcctctgctcctctgcccctggtacagatcgcaactcctcgccgcgcaccgcgcagcgccgggtccgaaggcagggaagcggctgctggagcccctgtgacttcaggaccctgcctcaccttgctcgccgcgtcctggcgtcccgccgcttgtccgccgggtgctgcgctccgagggccaaagagggagtcgcgcggcgcagccggggctccctcctgctgcgaggcaccagcacccgcaccttcgcaccctctgctcgccccgaccacttcaccctgtcctggcgcaggcggagagcacggaccctaacccgaatgccgctgcagttattttcaaaagtccccgttccaggcttcccaggaataggagctgagctactgcggccgcagcggcagagcctccgcctgacctcaccagggtgtgggggggctgctgagggaggggggcgg

SEQ ID NO: 1762 - DNA, 1100 bp, artificial
  synthetic oligo
tgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctga

SEQ ID NO: 1763 - DNA, 1350 bp, artificial
  synthetic oligo
tttgcccaggctagtctcaaactcctgggctcaggtgatcctcttgcctgccaagtagctgggactacaggtgcagtgcatactttctgtcctattattgctgatagtccagtgcaggaatggcaaatttgtttccttttgtggatcagttcttctggaatactgtttcccgaaggattttgagattgggtttgggctcagtgggaagatggctaagatctatcagtgatgtctcttgttgggtactggtgggggggtgttgatgtacttgtgccacatggttgccaccttggctaagggctagagtgacatatttatgtatataaataatggattatcaacaagacagaatattagcaattagagttatgaaaggaggtccaagtaaagtgctgtatacaggcagtggaaaaaatgatgggggtgtcggggctgggaggatacccagaaaagttttttgagggcagtgctagttggtctgcacattaaagcaagagtagaatctgaagagattaacaaaagggggcatccctgtcctcagaaggagtttgagtagagtggaaggatggattgtgagagaaagatgacagagataagcagatgacctagggattaggcaagaggtggagaggatccgctccatgcctggcaaacaggagaggaggacacagatctgaagtagtttagaggttgactcaccaggactccatgaatgggagggagatgctcaaaatgttatagagaagcacaggcttgggtggggaatggggagtagatgagaaatacgaatttcattttggacatgttcactgtagtatgctagaggaaccattaggttatgatttcctacagggttggggacactcacggatggcaatgagaggagggcagcttcaagagtcagggttatgggagccagctgccagggaaagaccaatgaggtcattcccaaaataagacacattgcaagccctctcagcacagtgtgaggacaacccaaatctaagctagctctgggggcagtcatggcatggtaggttagatgtcaaagcagagacttcatcacgaacttggcagcccaagagtaacacactgctgccatctgggggctgcatgtagaaattgtaatggcagctttgtgaaagccacttaatgagagaggacattattttggaaccagcaagacccttcctctcaaaagccttttatagttcttccttaaattcttttctgcctagttctacttctctgtccccaatgaaggaaaccatgggtgcacatgttctgtagcatatttccagaaggactgaacccctgaaagcagaatactttcagtcagctacagcatcc

SEQ ID NO: 1764 - DNA, 7050 bp, artificial
  synthetic oligo
agagttggggcccagagcctacatttcttttcttttcctttttttttttttttttttttttttttttttttttttgagagggagtcttgttcccttgccaggctgaagtgcagcggtgcgatcttggttcactgcaacctccgcctcccaggttggagagattctctagcctcagcctcccaagtagctgggattacaggcacgcgccatcatgcccagctgatttttttttttttttttgtctttttagtagagacggggtttcaacatgttggccaggatggtctcgatctcttgacctcgtgagccgcccgcctcggcctcccaaagtgctgggatttcaggcgtgagccaccattcccggccagaagactgcatttctaacaagctcccccaaatgactctgatgtcttgcccccatacttgaatgggtattggttgagagccttgttctccagctctcctctctgttaaatggacatactgctacttctttcacagtaaaagaggagatgtgtgtgaaagcctgtttccgcaatgcacgtgctaatgctcttcccgccccttcccctcttccccgtcttttccctataccaaggtgaagaacttttattattcacttgattttggacccacttcgtgtttaatgcacctggcctaagatgcagagttgagcccagggagaagggacgggttgggggaggaagaaagagtcgcaaattcccaggcagattggctccatcggtctaatcaagctgcacttgacgctccgcgggcctgctgcgcccccgccccctcaggcgaaaactcgcctctgcccaaggctgtgcggggcgtccgcccccgcacttcgctgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatgggctgagatacttcccaaaggtaaaaggacagagcccccttaccacaactaacctgtcccttcgctcagagagccaaattgtgacacccacttgttgacaaaacaccagtgctttcttctctgatatacccaggagactgatgggggatgggggagtccggtgctgaggtaatagcccaatatggggattccaggggctccatttctgttcactttggggatgggcagttcttcatctgggcagattccttagattgttgttgctgttgctgcctctggacaacgtcctggtcacaacaaggaatctctcctgtgggctgacaccaccttctgccccctccccagttaaggaaaagagagagcagccactcatgggagctcagcattagcaggctcaactcctgacggcgccagagcctcccctataaactctgaagctatgcgctggaggccaccggcagcccacggactccaagttagcttgggagacacgaaaagcaatatatttgctggagcacgtgaaggaacatgggaatcggaaagccaggaagccctgcactctatgtgagcagagccaagggcatccataggagagggagagaaaagagggaccacctcctcatctcatcctggagggcgatagaagaggactcgcgtgtgacctcaggccccaaaggtccctatgtttcttgtaggtgcctaggtccctatttttgcgagcaggacaaggctggggaatggggtggaggtggttgcacttaaggcagaggtcgagtgtgaaatgaatatgcagatttgggaccctcagggagtctgccctgccggaaataggggctccacggagctgagaggatagagtatgaagcagtgagtgctggtgtgtcgaggagaagcacagggctcgatgggcgggagagaggagagagtgctgtgaccagtcaattcacaacttcattgactgggacagggagcctcggagatatcatagaccctagggtttcaaactcgtctctgggctgtgttgtaccagaaatggctccggttgaaggtcccatggaggggtattggggttctgattatgttggcagttgatggtccactccgtggggacaaagggggttcagtctgaggccccaaggaaggagtggtagccaggcactacaagaagtgttccctgggctgccatgccaagaatctggcgtgaagtgcttctctttctagaaacaggctctcagctactccctggcttattgcccctgctccactcatgaccccaccatttgaccttataaccaccagcccactgccctcctggagccacgtacagctgctggtggagggtgtggagctcagtctcctgggctctgcccagtctcccttccctcctccccacagcattcaacatttaccttaagcctcagcctcctttaccctcctggccaaaaggagactgggagggcccttctgcctctaactctttttatttgagacagagtcttgctctgtctcccaggctggagtgctgtggcacgatatcggctcatcacaacctccacctcccaggttcaagcgattcttctgcctcagcctcccaactagctggtattataggcaaacgccattgtgcctggctaatttttgtagttttagtagagacggggtttcaccgtgttggccaggctggtcttgaactcctaacctcaggtgatccacccgcctcagcctcccaaagagttgggattacaggtgtgagccaccgtgccaggcctcagcttctgaccttttagcttaagaaaaactgggtcaggagcaaagactcaagagggccactccttgcatccttctggggcatctctgggcccctggcagcaatctcagtctctccagagccaagagggaccacttgtgcacccccagacaggtggcagctccactcaggcccccaaagccaaagaggcccccaacattctccagcttgcatagagtttaacccttaattcctccctaaatctactcctgggtgatatctacccttctcatctagtacagattcgaatattgttccatttcctgttcacgttttttggttttactctataaacacttgttgagtgatttgtccaaagacacagattatgctgctatttctttctattaccagggggagtagaaaaatgaataaatcctatccataccactacttccctttcactggagtgagcttggatgttcagtatagaccactgctttcactgctttgaaaacctattttgtgactcattccctttcatcctcgccccctcccctttttttttaaactctgacactggcttttagtttattcaagaaatatgcattcttcctaattggatacctgggcattcagatcagatgaatagagttacctaaaaggcttttagagaattttgtgtcggatagccttcatttaaagatatgggcttattttcttcctttctgccttcattctcattggtcgctaagagatgagaaattgctatttcatcttgtcagaagaaaccagtctctgagtgcccttttacacaatctccccgcttcctggcatcttgtccctccgtttccatgacatcccccctcacagttcccgcttcctgaccttttgatgcccacttctcggtctcctttgctgaatcttcttcttcttcttcctgatccttccataataatgatacaataaacatcattaaaatttttattttttttgagacacagtctcgctctgttgcccacgctggagtgcagtggtgcaatcacagctcactgcagccttgaccttcccggctcaagcaattctcccatct

SEQ ID NO: 1765 - DNA, 1100 bp, artificial
  synthetic oligo
gatgaggatgtggacaagcagtctctctcccacactgctggtaggactgaggattgaggcattcttgctggaaggctgaccaggaaatgcatcaaaggttgaaatataaaaatccctggatccaacagctgctgaaattgatgctgagaacatagctggacaagtgtaaaaaatttttatgaacaaagatgtttaccctagtttattttgtgtaatagtggaaaactggaaacaagttaaaagaccataagtaaaacttgggtgaataaattaggcttcatacttgcaagacaacgctctgcatttcaagctctcggtgtgccttcagatcattgagtctaattggaaaaattaaatgtggccgctctaaaaacgggcttaaaaccccaggccatctgtgttctctctgacccccagtgtgctgctccatcagtctggaactcttttcacctggcaaaacccttgtcaaacttcaagtatcctctcatctggcactccctcgggccagcttgccctgaccctgctaaagctcattccccgaatcttaggtagcatttatcattgtgttgtaattgcttgtataactagctgtcttccccactaggcttttatcctcccaagcctagtacaatgttgttggggcatcttgacacagacttcaggcacgttcccacctcaccagtttgcactggttgttctcattgttcctccaaatagccctgtgccttaatcattccccatgttcctgtatttgctcaaatgccatcttctcattgaagctgaccctgaacatcccatttaaaacagcacatctgatcatcagcactccgattctctcttgcctgctctatttttccatcacatgcctttcttctagtatactacataatttactgagttatattgtacattgatgtctctccccaccagactcaacgacagcaggcattctagttaactgcagcatcaccagctcctggaacactccctggaacagagctcattctcagtaaatatttgtggctggaatgaacaaagtgcctggcacacagtaggccctcagtgaatgccagcttttgttactgcctcctacctggaac

SEQ ID NO: 1766 - DNA, 1800 bp, artificial
  synthetic oligo
tagggaagtctcaggagaaaggaagcaagtgaaagtaaagtgagcatggtaaagagttgcacttggtaggatcagggttcagggagttcaagtttatatcaaggtatatcagcacatgcctaggtagagggagaggaagaaggagaggtagagaagggagaaaaggggagaggggagagagggagagagaggagaggaggtagaaggagaaggaaggggcaagaggagaggagggagcaggcacacacacacacacacacacacgtgcacccacgcttacatgcaagcctgctgctctcccacacctggtaagtgtgtcagagccctcctggtgcttgtccttattcatcaaagccactccagttctctttctagtccctttgtcaatcactctccttctctgctaccagggaaacttgactgagaggaagagaaagctaaagaagtatcaaattcctctctaagacatcttcactagtcttccagaacatctccgccttgggaagcagaactctgaggtccaggaagaccttccgaccaatccactgagacattgctacggctgcctcctcttcactttctggcctcttgagccaacatccaacatgatcttcatgagaggttgccggttacctttctaaaaacgtatttgaccagatttcttcatgatatttcaaaatgtaaaggcagaaaacaagttaaactttaaacaaatttaaatttaaacaatctaaaagggaatttaagtaagcgtatgactttgttgcagaggttctaggcttccttttttacaaaaggatgggaaattttaaagcaactgctctgactaacccagaaaaatctttctttgtttatctcctttgtatttagccccaatatctgagaaaattttaaacatagtttttttttctaggattggtgcctaagggtcattcccttacgaaaaccctaactttttttacacctttgttgaatgaaggagctggtggaagttcaaatttgtgtgttaacatgtgacttcaattagagtctgaagatggccacttgttagtaatctcacactgcatcattttaaaaaaacacagcatttttgttctggtgaagagagaggcactggaattcatccccattgtccactccccacccagtgtattttacagaaattcttaacaagtttaatagtgtgctattataacataattgcagcattacaccagaagcattatcaacactaagtattctccaatttagaatgcatgaataaagtctctaaaactcttaagagtatcactttttctcagctaaataaactaagttcaaagggtaaaaggaatatttcttcttatattgaaggtagcatgtatttgggggtagtattttgataagcatttgtgagctccctgctggtggattttaaaacctccttggcaatctcatggtaactatgaggagtgcgaaagtgtctagagcattattatgtatctgttatggtaacactagctctgtcactttcaacatatggcatcaaaagtcaccctggatgctgacaaaactagtcaacgcatgggaaacaagaaagagtgggttcttagattggcctgaatgtcacacatacctgtcataaagtatcacctagatgcaagaggaactaagaaatggtagttccgatctgcagagccacctcgctgccactatttagcatgatgaaaaggcagtactgatatttgggggatagctaaatggctttgccacagttgtattttggcagttattaggttattgtctcagctccaaaaccag

SEQ ID NO: 1767 - DNA, 1950 bp, artificial
  synthetic oligo
gacagttttgtgtgatcccaggctcatttatttttaagggcaggtaagttacaaaaacatagggcatccttttcttgggttatcatatctcccactcctcatggctcaaagttactgtccttcaaatcgatatattgaaaaaagcatgagccactgccagagcagtcatttctctcccagtgtgtggttatcctggcctactttggctcacaggagtgaaggaaacaagctgcttgtttaaattatggagaatcaggctgggcatggtggctcacacctgtaatctcagcactttgggaagccgaggcaggtggatcacgtgacgtcaggagattgagaccagactggccaatggggtaaaaccctgtctctactaaaaatacaaaaattagttgggtggtagcacatgcctgtaatcccagctacttgggagactaaggtaggagaatcacttgaacccaggaggtggaggttgcagtgagccgagatcgtgccattgcactccagcctgggcaacaagagcaaaactgcgtctcaaaaaaaaaaaaaaaatatggagaatcagtactaaggagttactcctttagtttttcaaacaaatggtcatcatgtgcctgctatatactatacctattaacccactgtggtagattctgatataattaacttcttaatgtatcattttgttttctgtttactccttcagcaaaattctttagggaaacttatgtaactggttcagtaacaaaagcaaacaacactcaaacatacttaaaactcatgtagcttttaaaccactatctacaaatattttcagttttaaggcaaaaacaacttgagtaccaggtatgactacaaaataaagtgattattatcttttaacaacaaacataatagggtgtactcactcaaagatataatctcccctttaatgtagccaccatgagagtccatgcctttgttctattggtgtggcaacaactgcttgtcttttgggactaaaattagacattacttccttctttcaggaagctggccctcactcctaaagctgggtttcatgcccctcttctgggctcctgtgcttgcgtcagtcaaagcacttgtcatactggattatctttctccttcacctggctgagtgctccctgaagatagggaggatgtcttctgtggtttttgtacccctggggccaagcatgtacaggactagttgctcagtaaatatttgttagttgattgaaaaatatctctgcatcacatttttggaccatcttcaacaacagaaaattttcattcttttaatggagaatgatttttggaaaacaaatgttattcagaaacaagttgggcacataaggtattcatctagcttatttaaaaatgagttatgatcataatatattgaccacttttcttctctgattcatagactggctctgagaacaactccaaaggaggaattacaaaaggttctgaacaatagaagcttcccagggcaacatcttcggttttttgtttttgttttgttttgtttgtttgtttgttttttgagatggagtctcgctctgtcgcccaggctggagtgcagtggcgcgatctcggctcactgcaagctctgcctcccgggttgacaccattctcctccctcagcctcccgagtagctaattttttgtatttttagtagagactgggcttcaccatgttagccaggatggtctcaatctcctgacctcataatccgcccgcctccgcctcccaaagtgctgggattacaggagtgagccaccgcacccggccagggcaacatctttgaaggactacattcatttatatgtttaagttacaacatgtgtctggagaatagtcaaataaatatttgccatgataattattgaatacatactctaggcagcagagcatacctttagaggttaagagcattactc

SEQ ID NO: 1768 - DNA, 1250 bp, artificial
  synthetic oligo
agctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatccca

SEQ ID NO: 1769 - DNA, 2850 bp, artificial
  synthetic oligo
ccaccccaaagaggggcacaggaacgatgggggaagaggcactaggatgtaaaccatgagcagtctgtcatctttggatttcatcagtcaaacaagcaagaggtacaaatgacagttgtaaggaggcatggcattggtacatgtaacgcactcaataaatttggtaaatgaataaataaatggtttaatgaataaggttgatcattttaggtaggaggtgaagaagatcagagggcactgaccaggcaaatacagaaaataatggtggtacaggctgggcgcagtggctcacgcctgtaatcccagcactttgggaggccgaggcgggcggatcacgaggtcaggagattgagaccaacctggctaacacagtgaaaccccatctctactaaaaatacaaaaaaattagccgggcatggtggcgggcgcctgtagtcccagctactcaagaggctgaggcaggagaatggtgtgaacccgggaggtggagcttgcaatgagccgagatcatgccactgcactccagcctgggcgacaaagtgagactctgtctcaaaaaaaacaaaatggtggtacaaagaggagtatgtgtcctatggaaggcaggaaacctacttagtgatagtaattacataatagtcttgatattgcttctggaccttgcagaacctaaaatgtttcgtctctgccctttacagaagaagtttcaccaatccagggtgcctccacattggatcactatagtgctgctaataatcgtaaaattaaaaggacaggacttgtgtggacctaaaggctagccctggacactaaggcctcaaagaaaagatagagttctggattctgagttgtcctagagcttaagggccttgatattcattggatgcagagcatgtcaatctgatgttttcagcaaatgagcttagagctcactgagagcccctccttgacccttcctgtcccgccccctgtcacttaccaacccgaatctttcccgccttgtctaagtcctctcaggccaacctcagcgggaggctcctgggatcggctccctgcccttcccaccttagggtgtcctcagagacagacttttattccctcagtaaggagacagactcttattctctcagcagcccagcccctcacctcccctcagccacagccacatcagtggccaccgtcttcaccgttgtcacctcagcctagtcgccactccagttgaggcactgactggcgtcatgtctgccacaggggatcaagacctgatccaagaggaccaggaggctccagtgaaccaggagggagcgcaggccgaggccgtaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcgtggcggccgcctgatgcggaggcgccgcactgcggcgcccagtggctcagaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccgcagaggaggcctcagagaagcccacagaggaggccgcagaagagcccgcagaggaggcctcagagaagcccacagaggaggccgcagaggaggagctcgcagaggaggccgcagaggaaccggccaaagaggaaccggctgcagaggaggagtccgcagaggaaccggccacagaggaggctgctgcccctgagggtgaggaacaggctatctgcagtggcggggagacagggacccgtgcacccaagggttccaggcagggccgcggtgtgcgcacagctggtgaagcaggtggtgaagtgggggtcgggcctcgggtggtgaagtgggggtcagggccctcctgaaacttaaggccaaatgtgtaccaatgagtcgaagcccaattctctaacgacatctatgatttttgagaaaacatgccgccctctaccaacctgtgtttgatagaagatctgagatcatcaatgccatttggggggcccacagatgaatggccaggtagataggggttcaggagggagctcggcaggaaacaagggacaacggaaagaaaagaacaggcaaatggcaggcatccttttttgttcatggcttttcaaagtgtaaagattcttagaaagttgatccccaaatgatgaagtgatacaggggcccttggtaaaaatgaaacattcaggggggtgaggaaccaatgagcttcaccatagaatttgtcttttgaggcaacaaatattttcccagcaaagttctgatcaaaacacttagaatgagatcagacaccatgattctgatctcttctccaaagaactagaaataatcggcagctttgggtgggagatttactggaaaaaagggaaatagtgtcactgtggaaatgatcaagcagcagcaacgtgagggccatggcactgttgtgaaaaccagtaggaaggtgcccagctattcctttct

SEQ ID NO: 1770 - DNA, 2950 bp, artificial
  synthetic oligo
tgtaaaaaagggaagggaggtgtaacagctaatctaccaggagtacccagataaagggcatctaccttaatatattgttcactatgggaatacaaaggaaataaaattcactcaatcaaaatagcattatcaaaatggcaaaggcacagtatcaggaaaaatagatgttatatagagaaaatgcaaaatttagcatgtaattgtactgtgtcacattataccagcatcaacaaaacccagcaccaagtgtttagctctgacacctcactacctctctggatttttttgcatggggcagcaccccactcagaatataaaggcacagtcagatgtccaggcctgcatttctgtttaagcaaagcagcacagtgtaacagaggcagacacagtgataactactcagaagtcacttctgggtctcctagaaaaatgagctaggtttactgcccagacatccaaagggagctctcccttagtgtttggtgggtttgggggatggaatgaagagaaagacagagaaaggaagatttaactaacttctagtgaacctagatgagattctagggtggtctgcatctcagaaagccagccaattaaggaactggctctgggggtaaaggtgcctacatcttcatcctcagccgaggagttattaatggaggctgtgctacaaaagaaaaagaccgtgtggcaagatgggaagggaggcatcaacatttgctgggccacttgccccctcccctcacagctgaccatccctctcatcctctttctcactctccctttttggtcttccctcttctccgtggctgggggatgagtgggtcactggaaggtagggtctctccagcctagtaacttttgaggtgtgtgcctctaggaatgagaggggaaaagctgatttactcacttaaagcttccaggtagcggaaagttcatttctctgtggctttgggattgcactcttgctttgggctaaaaccttgtgaagcaaagacagctgaggggaaaggacaagaagctacatggagttctccaccttaatgctggaaccagagaggaaggagctccagtggctccagatgtgcatcaaggcagtaagcttgccatctgcctgatggaaagtacagcttttggcatctgtagaactctaatttcaatagggtcttcagtgcttaacaggatatatgtgataggcagtgatttctgtgcgatcagagagggtcacagtagtattgggacaagaagcaaaacattgatggactaaccctccagaggagtaagataattcccaagaagcattctgcgtcatagggaggtgctcgctacagccaggcctgtgacaggtcgacgtggggtatgtccaaagagggagctttgtgtaagtgctctgcatgttactatcacccaaggagaaagcatcaggggcccccagggacacagggaagatgtttcaaggggtgataggctgattggagaactggctgtgcagaaattttcttggagacccagaattttcacttccaccgcctcttttaggatcccttgcaaagcttagagcaacaaccaaataattgcggcatctatctaggctcataaaacctaaaggccaatctttaggtcaaatcatctgaatgtttccattagaattactttatttggttgagggaaatgacaattttctagttgctccaacaaaatgtttttgctttctcccttctaaagcacattgtccaaagttaaagattttgcaattttacagcagtgcaaatgttttcgatagttttaatagaggaaatgctgggtttctgggtgctggcagtgactacgtggaaggttaagcattcatggcatttatttcattcaaataattatgttttaatttgcatttctaaggctattttgcttaataaattcttattttgcttaataaattcttagtttgcttaatacttattttgcttaatacaagtggtcacagtaaaaagatcactacatagaattaatacagctattagcaattatcatttaaaacgctgatgcttggccgggcgcggtggctcacgcctgtaatcccagcttttgggaggctgaggcgggcggatcacgaggtcaggagatcaagaccatcctggccaacatggtgaaaccccgtctctactaaaaatacgaaaacaaaattagccgggcgtgatggcgggcgcctgtagtcccagctagtcgggagactgaggcgggagagtggcgtgaacccgggaggcggagcttgcagtgagcggagatcgcgccactgcactccaatctgggtaacagagcgagactctgtctcaaaaaaaaaaaaaaaaaaaaaaactaaataaaataaatgctgatgctccacacaagagctctttattgcgtgatttctgccatgtggctccatgctttggctttcttcctggccagtgagaaccagacaggctcaattggctcaactgggttctggaacttggctgggagagttgaagatcgtttggtttctttttccatggcaggaacttgcagtatcttctgagcttcaaatccaactggaaccacagcaaataacacacaagcaataaggaaccccagcgatattggggtatgttgtttatggaatgccatataatgtttcctcctttcaggtttcctctgatccccctgctctagtgctttctaaactcttctccctttggtgccagacttctaaaagttaggacctgtgtgatgccatgggtagtatgtcaaaggggtaaaatcaacttggctatggccacagggccctgggcatgggaaggcctgggaggtaatacctatggctgtaactgccaatcttcaggtggttattactggattgtcttacatctttgaactgagaccagagggaaacatattgtatctacttagtttctaaaatttcagataaggtaat

SEQ ID NO: 1771 - DNA, 4600 bp, artificial
  synthetic oligo
gtgggagaggagactgtgaaccaatcctgtgtttctgcccaaatttgaatttcaaggcctattgggcttccttgagaaagtgcaaccctgctgatttggccaagttgtgatcctatgaaacctccttgtgttggggggaggtgggggtgttagggggatggagggtgcgagagtgcccaaggtttacgggggagcagtgagtgtttgagccagcaccatttccctcccagtcttcctctcccacaacacctggagcctaggaaaaagctcaaagaagaggacccgacagttcctccatgtgctcgcttccaagtgctcctactctcatttacattctctcctactgagcttatgtccccatcctctacctcttgcaaactgctgtttactggcctggtcaccccctaagaaggcaagctccttaagtgcatcttcgttcagtcaacaagattctttcaacaaatacttgtgccagacactgtgcttgcttggctccaggaggggaaaggaaaagtttctcccagagggagaaactagctttgtgccgaattgtcagggccaaatgaacccatgcaacgctcagtgattggagacttgcaatgagtgaggtgggtttctggctgtgattccaagttggaatagttaagggaaaagaagagtgttcactccatgattgaaaattggcaataatcatgtacactcacatacccactaattaaccatatgactaaatctattttggttaatatcttcttccttttggaattgcttgcaatacgtaaacatatgcacatacaacatccaaaaacaacactgtggacacataataagaatatactgcttgaatataataccccatcaagtaactgggagactgcatattgtacagcttggaataagtttagaaaattaagacaactcggaaaatttaaggtgattcttctctactcatccatgtttccctctctctttccatccctctctcggccttcctctcgtctctcttccacttcttggccccagtcccccatctcccttatctccctacaagatcatttattgtcagtcatgctagctgcttgctggctgcttactagtgccaaaacatcatgttctgatataattgaaccacattatttgacggaattattgctgtcagttatttgaatggtgttactaatcaatgaaatgagccttgtaaaatccaggtttgtgtggtgctttactttgagatgatgttggctaggtttcttgacacatagagaagctatagctttgtccagtctctctccctggtctgtctgttatataaacatcacccttgtgcagctctcccttctcagacttgagtcatttcttacaaactctgtcaaagtcaaggctgtaggagtgccacaaagtacccctgcaccaagtggtagggaatcgcggtgtgcagggcaggaagccccgggaataactaggtatttccaggtcagtcactgcagctgggccaagctcccccttggtgcttccctccttcttgcctttgtaagtcaaccaaagacaactgcaacagccttgggaatacgctcgacttccaatcctggcccctcggtccctggggcccaggtgagccaggtaggggtgccggccaggaaggagagaagcgtgaaaggcagagaagcctcgaggcgtccagccggccctcatttccccgcgtagagttgacctgtctctgtgtcccccgacctgccgagtcccagaagctgggttgaggactctcccgctgctgagctttcccactcacacgcacacgcacacctgcgcgagctctcccaggagggcaccgcccccaaccagcggggtgcacaggggaatgatgttgcaagttcgagcccagaggtgtctcgctgtcccccgcccacccccgggtcattcctcgccgcccgtttttgcggcgagagcaccatttgggcggttaggagcccctgcaaggccggctggcgttctgccaccctccactctgtggtgtctagggggagtaggtcggctgcgcccgccacttactctgaaatcttgaggcaagcatgaaagctagccatggtgctgctgagggagccgctggccggttacgtgccttgcctgctggggtgcatgggagcccgcgctgtgggcatgcccttagaggctgccacgtgggggcagctcggcacttcaagcgcccacccgcacgcagccccagacccacaggccgaagcaataaccagccagataaagtttcttctccaaggcctctcgctgtcttctgatctcagtccaaaaagggctgggcttgttccttacatggttaggaactgttaactccccttttccctctgtctccatcttcccgccacaacagcatccttagagcaaaataccagatgctctttcttagcctctctgtatccctgcagagctgagcgtgagaagtaatttggagatgaaaccctaaggaaagagtagaggcttttatccgagcaggaaaggacactcaagggctttgggaaggcgatgtaaataaatcgctttctggcattttagatggtgtgggatggagggagaggggagcagaggggagaagagagaggtcagggaagaaagaaaatttaagtagcaaggctgcaagcattcccatctagatgtgaacactgtttttgaggtgttctaagctgttcttgttcagtcttaaggaaaactatttactccctaagccagtctggggccatgaaccaaaaaagcaagaatttccttaaatttgtgaaatcttttctgccctcgagatgaaagtccctaccaaaggttgtgtgtacacggggaaccccaattataacatggcttacattacatggattcagagatgttgcagatcagattgtgtccacagaaaaccaaaagaactggagacagagacaacgagcaaaagtgtgacctaatgttgactgcctggaagacccagtagggcacctttcccaatctcagtcccataaagaggtgtgtgtccctaccttggcctctgagatgcacagatctgaaatattttgattttttaaaagtgcctagtgggagtgcgacacgcaaaacaaatgcagatgcaggcttttggctttttaaaatgacttttgaggaatcaagagtttcaaaagattgtgatttctcctgtgcatgtattcatgaggggcattaaacactgtctagctgggcctaatctgacaggctttccaaattgggtttgtccaaataagaataagaagaaagaagaaatttagctggggtcccttcagggggtcttcgcaagtctggtagcggaggcctgtttttcctttcagtctgaaataggcaacaccctgcttctggaatttcactgggtgggtaggctggggtctctggacagggcagtacatgtgaccctctcttattaactttggggaaaaggaacataactgagcaagaactagatttatgttgcagatgctaaagtctgacctgtggctagaatttctagctagaattcctttctaagtcaaatttgtggttagttctccattattcatatgtggctttgcttacccacttagtacatttcctgtaattgtgtttttaatcaaagaataacttctggaatacctacaccggttgtaatgtcagcaggctgttaagaaagaccaattttaatattggccagaaaagaagctaattagaaaggcaaatctatatcattcccttcccacccaaaaagaacacactttgaaaaacatgagctttggtgtttggataatgcatgctttgtgattctctgcctaactccttccttccattacttcaaataatcagaagtagagagtccacagaaaatccatcttataacccccaaactgcattgatggctccttctactgaaatctcatatcacctgtggtcaaggctctggggtcagagttgtgttcaaattctgactctggttaagtttctgaggtgcggtaactgcattgtgattgtgtaggaaaatgtctttgttcttaggagatacatgctgaagtatttagaaaggaagtgtaatgatatctgcaatttatgctcaattaggtcagaaaaaatgcataggagtgagtttgtgtgtgtgtgtgtgtagtgagagagagagaatgatgaagcaaatgtggtaaaatgttaatagttggtgaatgtaggtgaggcatatacgggtcttcattacagtattcttcaacttacctgtaattctgaagtgttttcaaaataaaaagttgggaatgagatgttagctctgcctgcctttaccaactgccttacagcaaattatttactctcttaaacctgagttcccttggctcaaaagtagagatattaatagaacccatctcaaagggttgttatgaggattaaaatgagataataagtgtgatgcctttagcatagtgcctgtcccttaggaaggtctcaataactgataggaattgctattatcataccattccattccacatcttattatatactgtcttttgttgtcctcgtggtgtttcaaatgcacataacttttctccttaacttagattag

SEQ ID NO: 1772 - DNA, 3200 bp, artificial
  synthetic oligo
aggagtgtgactaatttttatcaaaggctctttccagtttggccatcttatagtttatgtaaccataggtaaagaagtgtatcaacttaaaagagcagagataggaggaggttaatgctgagaccaggattgagaatcagtgggatacttcccgaggccaagaaaaaagaggtaggaagcaagaaggtatggcctgttcagtttgaagtttatatgggctgatttccatggagaaacaggcgggtgatctcttgggttttgtgctagcccttgataaagaagaaagccagtggagatgggaattgttttagtgactggttaagaacctttcttaagttcataatgattacaataaccccaatgaggctgaccttagaagttgtctgcgtttaggacgaaatgattcctttgtccctcatcaaatgcctcttttcccagcttactatttacaaaccaaaccaaaaaaaaaaaaaaacaacccacactcaaccaacaaatctcagtaattatattaacattgatagggtatgcttactatgggccaggctctgtgctaagaactttatttccttccaatatctcatttaatcctcccaacaactctgagatagggactattactgccctttttctgcagttgaggaaattgaggcaccagtctgtgctcagagcgtttgtggaaactaagggggataccagaaagtagaggcatgggacagtacattccctaaatctggaatagttctattaacaaaaatcatgtcagttacccaggataaagtcattgaaaggatttgcaggagccaagggagagcacagattgcttgctagtggaaacttttaattttctagcttaaggacaaattttcagtttttagactgtcccctaaaaaacacagccatgacttatctcacaatttatgtagtgtgcctttaacagttttatcgtgtttcctacgattaccatctttcactctctggaaagcagaggggtggtatgtgaccttctgtctccgtaccttcctcaaatgcccggctttgccttcaacatgaaaaaaatggacaccttccctgggggaagaggacatctatttccaaaaatggaaggaagaatctaactctgcaccccccggcctcccgcctccactgccctagccctagccccaagcatggtcacagcagattgctcattcttcaaacgtatcatgttctttccatctctgtgcctttggacaggctgttctcaaagcctctcaatctcttcccttctctgtcaaacaaatacgaattcagccaagatccatcttgtgaaccccactgcccacgcaccccatcccccgacttccagaagagtggatttctttgcctttcctcgggcaccaaggagagcattcgggtatggcatgatacagtcagtacatgcagggcaaaccagcaattaggctactctcttcaactgtgtatcctctccaacacacacatataccacatgtacacatcttacagagtacaatagagtattgcagttaagtgagtgaactcgagatccggacaacctagatttaagtcccagctttgtcactaactaaatgaatgacccttgagaaagtgcctgaaccactctgtgactcagtcatctcaactgtaaaatggagataataataagactcctctcaaagagtcattttaaggactaaatgagattaaatatatgaagtgcacagcacagtgtctgacatatagcaactgctccatcagtggtacccagtattattattgcacagagcttggtgcatagaggatggcaaatacatatttgagtgggtatctgaacacagtaagtctttaggggattaacttagggagaggtcagggacagttgggctactcaaggaagctgttttctcctgacctcattactctctcactgcaccctgttttttccttcactgcatttatcacaatgtacaattattacatgtgtttgattacttatttgatgttgatgtttcccaataaactaagtttcatgacgccagagtccatgtatgttttaaccaccaccatgtctcctgtacctagaacagtgccaggaagatggtaggtgctcaattaaagaattaaaaaataaatgaaactgagttaaagaataaatgaaagaagaattcaggagtgatgtggtggatgtaggtgtggtggatccttttgaaataccttgtgtttttcaaaatggcctgaactgatgtgatggatgtaggtgggcctgaaggataagtaagagttgagttggtaggcaagaaagcttctaaatggaagggaatcctgggaaactccagcacttggtggtggaagatgcagcgaacagggtgcaataagtagatcccttggtctggaagaacaagagactgtttctgtagtgtagtttacataggggagtagtgagaagactggtagggggttgtagtgaatggctttgaatgccaggctatcagggattcattctattagcttaggctttggcctctattagcatgcaaatattcctgggaaaaaattatatattctcagccaagtataagtgtgtataaattagtttacttgctctttgccttagaaaaaaatttgccagaggggaaagcgatagcaggaggccactggaaagagaaaatagtgccccgagataatcaaaagcatataaaggggaaggggaagacaaaccttacttatctccagggttgtgatggtccagaacctgaacctcaaactttctatagtttgtttcatcacaaaatgactcttctttattaaaagtgcaggcaaggaatacgggtgttaaggaggtttttaatcactgaataaatctgttacctgtttataggtctgatgagtgtttgaaatttgtttatcttgattatctaatttattatctatggtttcctgtgtcattaaaaaaatctttgtaaacatcgtttctgatggctgcatgacattctatcatatggttgtcccataatgtaactattctcttaatggttctcctctagttattcacaaggctgacatgaataatatctttgtaccacaatctttatctgtactaccactatttccttaagaaaaattgctagacatgacatttttagtacaaaagacccaaaatttcttaaggttctttcatcttgccaaactgccacccagaa

SEQ ID NO: 1773 - DNA, 3550 bp, artificial
  synthetic oligo
tcactctcagttcagctcaaagctctcaataacctagagactttttagaaacaaagtcctctctactttcttcctggcataagtaaagttcagatctccttgtcacaaagccctggccatcctctgtggcaagagtaaaagagagaaagacaaattttgtttagcgatgaacttatagcagaaaaaaacagaagacaattcattttcaattagattatcttaccataccaaaaaaagaaaaatcaaggaaaggataattcccacatattaaccctagatattaaccctagatatttctgcttggtgggaaagtgggatcgctcctgtatacatgcaaagggatggagagagagagagagagtgtgagtgtgtgtgtgtgtgtgtgtgtgtgtgtgtgtgtgtgtgtgtgtgtggtttggggcacatacaagcacaagggaataggggaatatctttgacaccttactgcctgccacttctttgttggtctctcctattttatttaagtcttctgtccctaccctcatattttcctcaggctaaagaggatatccactgtgtgttctatggagcaaaattctctctacttccatccctattcaccagttagctctctttgaggtgacaatggatatgaaagggttaataagattcgaaagaacgtactattgctttagcaaaccactgtgtttcctaggcaacataatgcctgtatttctcttgtttcttcctgtttccaaaagcccctatggagggaatggtaaaaatattagccttggccaacactcaagcccttgctgtttccctctctctccccattctgctcccctcacagttgaccttgcctcctacttcatggaaagcattgaagctgtcaggtttgaattccctctccctctcctcttaaaggagaagctatgatccttccacctgttctttcgatttcatcctctcttgtctcattccatgccacaggtttgattaatatccactctgggcggggtgaggtggctcacacctgtaatccctgaactttgggaggctgaggtgggtggatcgcttgaggtcaagagttcaagaccagcctggccaacatagcgaaattccatctctattaaaaaatttgcaaaaattagccaggcgtggtggcgggtgcctgtaatcccagctactctggaggctgaggcatgagaatcgcttgaacccgggagacggaggttgcagtgagccgagatcccaccactgcactccagcctgggcaacaagagcaaaactccatctcaaaaaaaaaaaaaaagtacccactctgtcctgtattttcaacctctaagccttactacctatcttgctgcaactgaagtctatgatagttttcagaagaacgaaaatcaaaccagggaatccaattccctcttttccctacctcctctgccttagtcaagcttctcaaacttcttttttgagagatagatctcctcaatcctcatgttccactcactccctaggccactggaaccagacttccacccttctcatgccacaataaaaagagtctggcataggtaacccaggacttcctaactgcctagtccaacttacaccttagttttcatctttcttgatccatttacagcccttggcattgtaaacctctccctcctggaaaccctctctcctccctttgcttctatcggaccacattattctgccattttcctaccacttgtggtttttattctcaatctccttggtgggtttctcttcctctacttattcctacaatgttaatcttcccaagactctatcttggccctctttttctctctgcaacctgcctataaatgtcaggccagtcatatgagtaagtaatgcgagtctggttgatgtgtgacaatgtagtatatgccagaaatcacaaagaaatgtgatcttgccctgtttttattttgaaatagtaaccctgttatctttcattttccacttttgatagagtcataggtacaaaaaaattttgattatccacttaattctgctttaacaaaaacagagcaaatgtgataaaagacagctgatacttattctcagcattggggatacagcagggagaagtggggcttctttaggtgtacctgctaaaggaggcagctgctaatcagagatataatgccagatcttctctctctctctctctcttttttttttttttttttttgagacaaagtcttgctctgttggctaggctggggtttaagtgattctcgtgccacacccagctaatttttgtatttttagtaaagacagggtttcatgatgttggccaggctggtttcgaactcctggcctcaagtgatcttcccaccttggcctcccaaagtgatcttctcattttttacgagaacatttttatgtcagaaatacaggttttatgtaaaaatctgttggttaactgcttacatctaatattttaaaaattaaaataatgtgagggtcaaataaacatgtgcttgagccagctgtagtcaccaaggctaacaattttcaaccttggcttagaacattgtgcaatgagccttgaaaagagagagacctctgccctatattctccttgggatctaattcaatgccagtggtttcagctaccacccataggctgttacctcctgtctttacccctccagtctagacctccatcctgagccccaaacccaaatatccaactggacatattactggatatccccaccagaatgctccttatgcccgtgcttttcaaacattaatgtgcatgtgaatcatctggaagacttgttaaaatggagattctgattcagtatgtctggcatactgcccaagatcgtgcattcccaacaagctcccagtggatgccaaagcttctggtttatgaaccacactttaaaacacaatccccatttgcatacaatgtcctttttgcaagtttgctcctcctgctacttatcttctcttgatgaatgatacgccatccacccatgcaaaaattgggggcataagtcagatgtagaaggaatgggagaaatagaggaggaatccaaagctctgtctcatccacctccttaatatttatcatatctacccttgcatttatgtcctcactatcccaacattgatttaagccttcattttctcctgcggtaaggctggtgtccctgctctagtctccacccctccaattgcaacctccatgctcctacgagcatgacactttgaaaaagcaaaatgatctcatgtaaagcatgggctctggggccggagtgctgagtttaaatcccagcactgcctcttactaattgtgtgactttggacaagtagcttaacctatctatgtattggtttttttcatctatgaaaagaggatgataatagaccctcacttgtgagataaataagatttgaaagcaggaaggggaatgacccattagaatatctggggaagagcattccagacaaatggaatcacatgtaaagtgttcatagcactcagtaaatacacattagctgtgacactggccac

SEQ ID NO: 1774 - DNA, 3500 bp, artificial
  synthetic oligo
cttgtgaagcaggacttcctttaatccattatcctccaaggggacacagaggtgtagcagaagagacactggactacgataaatgagaattattaatcctccccatccctccatgaaaacactttccccagatttaatagcggttacctttgaggaaagagaatcaagagtgaggagagggacttcagttgtcttctatatcttcccatagtttgaattttctaactttagacaaatattactttgaaaaaacattccagcaggggttatctgggtggggagctaatggcttggtttttgttttgtttttttactctgtgtctctctttattggaaaaaaatgataaaacttttattatataaaatttcccccagttttataaaacaaaatgtgtgtgtgtgtgtgtgtgtgtgtgtgtgtgtgtgtgtatgttgcatgtctgcaagaatataagccaaactgctaatgtatgggcctgatttaagtactgtttggggaacttggagagggagaaaggagtttcattttttactttatacactcacgtattgtttaagtttgttatagtgaacatgtattatcattctacattttttttcagaaaataaataataaaccattttcccccctgaggttaaaagtgacacatgcccattgtggaaaatgtagaaaggtataaggaagaaactaacaatcacaacagttaacattttagcatatttctttccacgctttgttttatgaattttttgacatagttgagttcatactgtatatagttttgtatcctgtttttccctcaagattaaaacacaagcgttttgccatgtcatgatttttggtaaaagaatttaccaaaacagttttagttaaaagaaggtagatttattagataaagtaggaaaatatgttgtcagagagacaaagggcagcctgcaagagagaagccaactgccaggagacaaaggcttgctggaaattttataggatggcgtttatgctgtctgttgaagaggtctttgtgtaatattgataatgccaaggtcgcaatgagctaacttacaggtgtctggtgatagctgggcatgggaagattgtgaattatttgcgcaggaaggctgcatcttggtcatgaagaaagggagatttgtagcttatttgctttttctttttgctatttcatgctcccaccagcctgattccctttccctaattaggactccagaatgatgatatttgaatggccttttaatggttttgtcacaattcaagtgaattaattcgccattttatttgaagtcggacatttaggttgtttccagtttttctgtattaaaaatgaatctctgctgagcatcttagtaatgaaatatttgtctgcgtttctgtctccttgggatggattcctgaaaatggaattactaggtcaaagagcagatttctagaagtgggattaatggatagaaaatatttttatggataataaaaggttatacccaacagcgtatgtgagtctcaccactctctcgccaatagtgtgttatccttttttttttcccttttatctttcctgtagaaaagtagtaggtgacagcggcatctccatgcttttctttttgttactaatgagactgaacatttttcatatgcttattcaccactggcatgctctcttttgtgaactacctgttcctattttttcccatttattgactagaatcttatacattttcttatcaatccaaatgatctctcaaataaatattaaccctttgtcatattagttgcaaatgaaaatattttataagtttattagctttctaaattttcttggccatacatgttaaaagagatagattctaactatagacaagtgccctcagtttgagcctgtttctccatgattaaattgaagagttttgacaaaagatttggaggggctgtttcagctaatcccaaatttagctctgagaaaaatgcctgggcccgatacaaagattgtttggctcattgcactttataatgatttaagaagatgtggggggcagggatggaagcagtttttgccagaaatttttagaattctgaggtaggaagccaatctttactcaagtctcttgcgtgttgggaggaggagtaagttatgtgcaagccaacagaacacttggtggaaaagtactgctctgggctgcagatgtgtgcacggcttggttttaattatttgtttccctctctatcctttcttctcctcccctccccccgccaccagaaaaagggccagattaggacgaggcaaccccttcctccgtggaggtctgcttctgtgcagcctgttagcacatcaaaggccggatgaaatacctaggaaaggaagggaccaggcctaggatccttccaaactcccgcctttgtctgggctccagctcagggttattgtgactgccaagggtagcctgacagactccaaatagaagaacgctgccaaacaaagaaactttcacattattctgaggggggaaaaaagagcaacaagagaacgttgcttgttaatgcctggtgactgagcaaatcagtaattgcaaaagggtttttcggagaacaaacccaaagttaactgggcgatcagattcgtttccccagataatagggagagttgtgcactgactttagcaatcccgggggtgtcggtcccacagcatctgggggagaattggggaagggccatcaaggagagcgaatgggggttcccaaggtgaaaatgagtcgtgtagggctctaacatagaaaatggagttcgaagaatgagtttcctgtctcctaagacagcttggagggcccgggaacggcagggggaagatgaggggcttcagaatgggaggcagggaaaagcctgcagcaacagaaagggagtcggtgtctggcgcgcatcaggtggcggaggggcgctcgcacagagcccggcaatgccgaggccctcccaacgggtcggtctgcgaggagcaaaaaaggggttcagaggagggcagcgcgtgcgtcgcgctcagctataggatggcgcgaggatggcgtgaggctgggctggggcctcccaggtagaactgaggggggcaccgcgcggccgcgggggagcggcgccggactctagaggctttggagggggcctgagggctgcggggcgggaccgagcagggcggggcgcttaggtggcctcgggggaggcggggcttggaggctccgcccctcaggccccgcctcctccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgc

SEQ ID NO: 1775 - DNA, 3850 bp, artificial
  synthetic oligo
ccttcatctttctcccgtgttggatgcttcctgccctcgaacatcagactcagcttttgggctcttggacttcagcttttgggctcttggacttataccagtgatttgccaggggctcttgggcctttggccacagactgaaggcttcactacttttaagattttgagactccgactggcttccttgctcttcagcttgcagacggcctatcgtgggacttcacctcgtgatcgtgcgagtcaattctcctaataaactccccttcatatatacatctatcctattagtcctgtccctctagagaaccctgcctgactaatacagaaggaaaggcataaatgaagtagtcactcatctcccaatagctgttgtgcgtatgtagatgaaaaggagtacagagttacctatgcaaaatgtggtcattgtataaagaacgacttttcaacactgtgctaggggttatgagaaataaaagagaaggcaaaacccagctcttattcctaaggactttaagtttcagttggaaggcaagttgtcatatgtgaaatgtcaatgtttatcttacttcaacccctaccccactggtcctaaccctgttcctctgtgagtcttccccagaaaatacttacggagatgtcttcaggctgaggagccaaggaaaatttctttgggtattgtacaccataccctcaaattgttctattgtacttaggtcctacgtttaccatttagagctaccaactcattctgctttgagtggaacgttccagaaaaagccttgtttcaggaaccccatcagtcctgggaaaccagaatggttggctatctgagcccatattgctcacagcattgccagtgccagcctgggtgaccaagtgagaccctgtctcaaaaacaaaaacaaaaacaaaaaaagttcctgagagtttcatacattttttggtgatatcagcatgcaaataagatccacatatcacaattggttgatacgtcttttaagtctcttttcatctataggttcctccactatttctttttttttcccattagaattgattagtaaagatactagttaatttttcctatagagtttcccactgtctatggattttgctgattgcatcctagtaatatatttcaagtaaactggtagttagatctaggggcttgttcagattcaggtttgattttttagcaagacagcttcataagtggtgctgtgtactttcatcagaggtacataatatctggttgtctctcttcttatgatgctggcagccattgatgaccattgcctagtccactatttcattaggaattgtcaaattgttaccagggggtccttgctcccagagctcccaagatggtggcaagcctcgcgttctctgacctggggttcttgacctcatggattccaaggaatggaatcttgggccatgcagtgagtgttatagctctattagaagccgtgggtcatggaagagaaccatggaacccagtgactagtgttcagctccatcaggatgaaacccgggcacttagccgtgcaggaacaatggcaagcctttagcctgatcgggagcggcaatgggcaccttgctggatcaggagcacagtggacaccctgctggatccggagggatggaagtcagtggcgggtctgcaacggcggcaaacaccagtggtggatggcgagcgaaagctcagctgtagccataagaaacatggaccaaaagagagtgcagttgcaagatttaatagagtgaagacagagctcccatacaaaggcagggggcccaaaaagggtagccgttgcaggctcaaatgcctgggtttatatcctgatccttgtccctcccgctgtgctctcaggcaacagatgattggctatttctttacctcctgtttttgcctaattagcattttagcgagctctctttactatctgattggtcgggtgtgagccaagttgcaagccccgtgtttaaaggtggatgcagtcacattcccagctaggcttagggattcttagtcggcctaggaaatccagctagtcctgtctctcaaaatggcaatattctatcattctttcttcacccattaactggaatactcctatgaaaagaaactccccatcaacaaattttttactaccccgtggtacaattgtatagaaaagacttcagtgacaactttgctgatagatctccatatgcacctgtgaaaggaaaataaatcttgggaccccaaaatcactaagctaaaggaaaaagtcaagctgggaactgcttagggcaaatctgcctgccattctattcaaagtcacccctctgctcactgagagagatgcatatctgattgtctcctttggagaggctaatgagaaactcacaagaatgcaaccgtttgtctcttatttacctatgacctggaagctccctccccacttcaagttgtcccgcctttctggaccaaaccacaaactaatgttcatcttacatatgttgattgatgtctcatgtctccctaaatgtataaaatcaaactgtgctctgactaccttgtgcacatgtcatcaggtcctcctgaggctgtgtcacgggcacatgaccccaaccttgccaaagtaaactttctaaattatctgagacctatctcagatattcagtgttcaaatttcggtaaccacaaagggattctgagtggaggtacccctgaactttgacaaatctcatattggtgcttggtaccagcatgagcaactttgtggctcaaaccaataggacaatttgctgaggtctgggagcaccccctccagagaatccctgatatccctaaatttggtagagatctaaagtttattttgctgtacaactcccttttttttggagttttacttgcttctaacacggaaggcaagattccctgcttccatgacgatggaaagcaagtacctcctttatggagtttgagctcactcccaacaagaaagacgagtttgagtttttttcctgcttcaaggatagtagaaagcagtcttcaacctgagacccattcctaggtaagttaacaaccagctggttttaatttctccttaccattagagtgctcagtgatcatattgtcggggttttttgttgttgtttgtcctggtctttctcccatcagatttgaccaactccacctgacttggtcaaatccgagtgagaattccaaattatggataacaaagcctctctagtttggcaaaaattcctcgcagctgcaaaagaggaaaaaacaaaaaaagccatgcgcttggattttgtgtttgcttcctgtcttaaaaaacaaatgttctttcgtttacttttcttccactctatacctccttccccctatgccatctgcagtaccaaaaaatctagagaaggcttccaatgacttgagcccctttcaagaaatcagaacaaagataccactcaccccttttggagtgttctgttttccttgtggagttccaagagtcatggacagatttttcttaggtctaaagctctgttttcctgtattgcatgacctgacctttttggctttgggagtaccagaaataaccttgtactatgagagaacttgacctcggcatgtgtaatggcagacgagagctacaaaattaggggtggctgagcacagtttacaggaagtggtcttcactgttgttgttgttgtttccctcctaggaaactgttatttaaggatcttaattctagttcagagatgtattctaaagggccttctctattgctttttctcccaaaattaatctcgattcagcttgtctgtgcgcatttgcgtgaggaactgaactgt

SEQ ID NO: 1776 - DNA, 1300 bp, artificial
  synthetic oligo
tgttgcccaggctggagtgcagtggtgcgatctcggctcactgcaagctctgcctcctggattcacgccattctcctgccttagcctcctgagtacctgggactacaggcacccaccaccacgcccagctaattttttgtatttttagtagagacggggtttcaccgtgttagacaggatggtctcgatctcctgacctcatgatctgcccgcctcggcttcccaaaatgctgggattacaggcatgagccaccgcgcccggccttttcagtttttattattttctacagtctggaccaaattctattttttcttggttacaagtcttcaagataatgttttcaatttttttccttcttttttcccccatttttcctaattaggagtcattgaaaactaagcgtgctttcataaagccctgtgaactgaagtcagacaacttaaactttagaagaaaataacagcaacccatttacatacataaaccactttcaaacctgcctactgattatggacttcagagtaatatggcttataccaattttccaggattgttcttttgtttgttgttgttgtttgtttgttttttgtttttttgagacggagtttcactctgccgcccagactggagtgcagtggcgcaatctcagctcactgctgcctctgctcctgggttcaagcaattctcctgcctcagcctcctgagtaactaggactactagttactagttagttgtcgtaattactaatgcccggctaattttttgtgtttttaatagagacagggtttcaccatgttgtccaggctggtgttgaactcctgacctcagatgatctgcccgcctcggcctcccaaagtgctggtattacaggcgtgagctaccacacccagcctgttgttgtttttctccctattttcacttcctaggatgtgaaacttcacaacctgctaaaaatgaactttcctaataattcaggacctaaccatctagaaataaaccaaccgagccataagagatcagacgaaacctgagaccagagactcattttcttctgaaatgctttctccaaaagatttttaaaaagaaaagggggggaatgtgaaaggaaataaatcttgggaccccaaaatcactaagctaaagggagaagtcaagctgggaactgcttagggcaaacctacctcccattctattcaaagtcacccttctgctcaccgagatgaatgcatatctgattccctcctttggagaggctcatcagaaactcaaaagaatgcaaccatttgtctcttatctac

SEQ ID NO: 1777 - DNA, 1100 bp, artificial
  synthetic oligo
tgcgatggcttggcttgggctcagaggcctgacaataatacctgtgaattttgagggaaaatgaccttgaacctagaattctatattagtcaaatataagaataaaaataaaaagacatgtttaggcatgagagaactcagaaattttacccctagccctcttctctgaaaaaaattacttgaggatgtattctaacaataaaaaaaaaaagagatccaagaaagagaaagacctaggatgtaagaaacagagatgataacccaggaatgcaatgaaaaaaaaaatcctaaaatggtagctgtgaaggagtgaggcatagaaagagtgggtatatgttagagcatttaacaagtcgtctatgtgaacaattggaaggtatcagtaatatggtgacaaaggcacctatatcttctgccaaaaaataattagaaattttaagaaaggaaaactttcccaaaaagtcatgatccatatatcaaacaatctaaaatgtggcataactcagcaattggagtgtaagaaaagaaaaaccatttgaactggaaatttgtactatttcccttcaagtggcctaggtatagggatacaggattacatctcctccagtgatcaaatcacacattctgttttctgcaactaataacatttacaaaattataattttgtaagtgatgtttattggctttcagaatcaacctatagaaaaagtatgaaagacaaatatagttatagaatggaatgtaaatatgaaaatggtttaaactttaacaatgttaaagtactcaaataaccaggaggagtggggagtaatttcttcatttgacacagtaagcctcaagaagtaagtgtaaatggaagcttaagtacattatgcaaagtgttaatggtaaacaattgaggagctaacaaaaaagaggaaagtcaatactgcttaaaggaaataaatcaagatttcaaagtaaaagcatcttattaagaattatggaaataaccaacagaaaaaaaaatcccagaaatggtcaaaagaagctcaaaggtatcaaatgatactctgattagtaagactgagggtaagagcaggaagaatctttgtactttt

SEQ ID NO: 1778 - DNA, 2600 bp, artificial
  synthetic oligo
ctaatttctaatacagtaaatatcaatggctataacccatataagcaaaatctatttggttcctcaataatttgcatacatttaaagggatcctgagaccaaaaagtttgagaactgctgtgtaattctcaataaaaataaataaaaatgagcaactactgctactcacaacatttctaaatttcacaaacatagagcaaaagaagccagacacaaaagcatatatactattacatcccacttatataaagttcaaaaccaggaaaaactaatttatgatgttagaaatcaggatgttggttacattggggtaagaaagaggggtagtaatttagaaaggaagcatgacgcttctgggatgctgccaatgttctattccttggcctgagtgctaatttaaaaagtgtgctcaatttgtgaaaattcattggtgttaagagcacttttctgtatgtgtcatttgctttgttttttaaacattgaaaaaatatgactctgtaaatcttagctctgccattttctagccatgagttggaaaaattacttgactgtgtatcatttattcaacaaatatttcaacatttcttgaagatctatctactgctgggtactgtgttatacattacagatagccgcagtatgtaatgcacagtcccaggtttatctagtgcagtgcgagagacaattatcttagcccactttgtgttgctataaaggaatacctgaggctgggtaatttgttttaaaaatttggctcacggttctgcagacagtacaagaagcatggccatagcatctacttagcttctggtgaggtcctcaggctgcttccactcatggtggaaggcgaagggaagctagagtgtgcagatattccatggcaagagaggaagcaagagagagtcaggggaggtgtcaggctctttttaacaactagttctcaggtaactaagcaagaactcactcacccaccccagggaaggcattaatctattcctgagagacccactcccatgacctaaatttctcccattaggctgcacctcccaacaccatcaaactggggactgaatttcaacatgagctttgatggggacacatattcaaaccatagcaacaaccattaaaagtatcatcacggccgggcgcagcggctcactcctgtaaccccagcactttgggaggccgaggcaagcggatcacctgaagtcgggagttcgagaccagcctgaccaacatggagaaaccccgtctctcctaaatatacaaaattagccaggcgtggtggaacatgcctgtaatcccagctactcaggaggctgaggccggagaatcgtttgaactcaggaggcagaggttgcagtgagctgagatcgcaccattgcaccccagcctgggcaacaagagcgaaactccgtctcagaaaaaaaaaaaatcatcacgggggtgttaatttttacaaaaagagaggtacagcatgttgtagagtgtataacaatggacttaaccttacccagtgagtccaaaatgaagagatgacacttagctgaactgtgaaagacaagtaggactagtccaccaatggaatggtaagagttacttggcatctccatttggctgcctaacaggcatctcaacttatcatggtcacactgaactcttgatcttccccctctccgccctctccacttggcccaccttctcctcctgaggtgttcaccatctcaggaatagcaacttcatcctattcattcctcaggccaaaaccttcagaatcatccttaatgtctccctttctgtcacaccccatatgcagtgccagctttacctgaagctaatgaagttttagcctcaggaaccctcatattccaaggccctggaaaggcccctaggaatgtgttcacattgtcatatatttttgtaaaatttgcgacagtaagatattcttactgcagtcagttaagaccactgtatctttccattccaaatttccttccatcatgtttccccttgtattaggtgctgttggagtgaccaagaacatttttgggatcctgcttaggtgaagttgagttagggatacatttagctgggctttggcaagatacatttatgtggtttgcagtcacttccttgtgtactgcatactgctgtcccaataaaaggctggcttcctggaacaccccttacagcccatgtgctgactcacctggtatagtgacagaacagtagagaaccagaagtcataaagtcatattgtgatatgaatctgtcctatggtacttgacactggaagcatagaggtagtagaggtgacacaaggtttgaaatgtacacagccagaagctagactgtgggaaatccttctaaaacatagacttgtatgcagaagatttggctcttactgatgcctagattaaaatgggatttctcatgccaaggcaggcggatcacttgagctcaggtgttcgagaccagcttgagcaacatggcaaaaccccgtctctacaaaaaaatataaaaattagccaggcttggtggcgtgaacctgtattgtagtcccaactggttgagaggctgaggtgggaggatcgcttgag

SEQ ID NO: 1779 - DNA, 1650 bp, artificial
  synthetic oligo
gcagggcattgccagggcagctagtggggacctcaggaaccatagatttgtggctaaatacctgaaccctcccatcctggggaggactgggatttatgtggtcagagccagagtgtgaagcttctgccagaggcagcacagtctgccaaggacctgaaggtcaggtcaagccaaagccctcaggagaaagctggggtttgatcaccaggatgacctggtgcaggcctaaatccaaagagtccaagacaaggctcagactgagcaaagaatccaacactgcttgcctggccacatctccctgagctactgatttccctcctcatgttcccctttctgtcctctgaattcaagtcctggcactggctttcctgctacagccttggcccttctccacataagtatctggctttctgcctcaggctgcctgaggaaaagccctgagacaacctagcccctgggaccctgctacccaggagtcaagcccatggcctgcactcccggcccatttgtcctgttcccttcggtggcagagagaccagcaccctactcatgggcattagaatctcactatcagacccctggcaaggccctgtctgggcagctctcccgtttcaatattgctctctggttgcaacactttgcaggcatctttctcagtgtaaatccacaaattggtattctggattcgcaatcaaccagttacaaatttaggtagggcaatcccatccctagacctgaacacttttgggagagctgacaaagtttctgaatcctcaaatttgcaaaacagaccctccacccctgggaggacccgctcaaacagccaactggtttctttctttactacctcatcactgaaacaggcagagtccaagagacgattctgaaatatagaaccctgtctaggaaggcaggcttaaggagggcctccaggaagggactgtgagcaaagcataaagtgtatgcaggtgtatggtggtggggggggcaatggcaagaaggaggaataggaataagagcgtagttaagaacgtgggtgggagagggtgggtgctgagaattacttaatagatacaatgcacattatttgggtcatggatacactaaaagcctggatttcagactgtgcaatacatccacagaacaaaattgcatttgcacgttttagatttatacaataatttttaagacaaatgtaggctctgcctgtgtttgcatctcagtccagtttcctcatttgttaaacagaatcataatatctgaagtccagtttcctcatttgtaaaatgggatcataatagtatttaccactatattatgagaattaaatgagatagtaccacggaagacttagcacaatgtccagcacataagaagcactcagtatatgccacctgttcctagaggagagagtgaggccaaggaggttccaacgggaagaaaggagaaataaatgcagggagatgagaaagactcagataagctgcctaatttccacttttttccgagggccagctttgactattttaggtgttttaccagaaatgtatttgcatcatttgtaaatttccctgtcactaccaatttccacttccagctctgtccttttttatctgtgtgtgaccatgggtaaatctcctaatcactcca

SEQ ID NO: 1780 - DNA, 1650 bp, artificial
  synthetic oligo
aggtgggggaaagattgagaaatcagatggttgccatgtctgtgtagaaagaggtagacatgggagacttttcattttgttctgtactgagaaaaattcttctgccttgggatcctgttgatctatgaccttacccccaaccctgtgctctctgaaacaagtgctgtgtccactcagggttgaatggattgagggcggtgcaagatgtgctttgttgaacagatgcttgaaggcagcatgctcgttgagagtcatcgccactccctaatctcaagtacccagggacacagacactgcggaaggccgcaaggtcctctgcctaggaaaaccagagacctttgttcacttgtttatctgctgaccttccctccactgttgtcctgtgaccctgccaagtccccctctgcgagaaacacccaagaatgatcaataaaaaagaaaaaaaaaaaaagaaaagaaaactgttaagatcattcctattccaacattcttattctatcttaaattcttgtctttttctttgtgaaagggttatgggttgaattatgtcctcagaaggatatattgaagtcttaagccccagtacctgtgttactggtggaaggtgtccaggttcttggcattttgaacaaagaattggacaaaatgcacaggtttgtcaaaggtcagatggctgtaggtgtgcagttttatttctgggttctctattctgttctgttaccagtggagggtgtccaggttcttggcattttgaacaaagaattggacaaaacgcacaaagcaaggaaagaatgaagcaaggaaagcagagatttattgaaaacgaaattacacaccacagggttggagtgggctgaagcagccgctcaagggccccgacacagaatcttcttcggtccaacactccctagaggtttcccattggccacttggtgttccccttatgtaaatgaagtggtggcccacagtcagaggctaaagtgaagttacaaattgcacttctatgcaaacaaagacttggcccgcaatcagaggctgaagttacaaagttacaatcctatgcaaaaagcaaccaatcagaggtattttcaatttcccatctgccccacagaaagggtggggatttgcaaagggagtagcctctggtccttttgttacttaggcgtggaaagttagggttttcctttccatttccttctaggaagtcagtgtgaatcagcctcaggttccctacctccagaccctattctcctacctcacctgtaaatgagaacttatttggaaataatcaaagatgtaatcaaattaagataggtcattagggtgggccctaatccaatatggctggtgtctttctaagagtagaagatgcacagagacacggggaagaagacagccatgtgatgacagaggcaacaattggagcgatccatctacaagccaaggaacacccatgattaccagaaaacaacagaagctagaaggagacaaggaaggattctcccctccaggtttcagaggggcaggctctgaaaacaccttgatttcagaattctagtgtccagaactgtgagaaaataaatttctgttattttaagccacccagtttgtactactttgttacagtagccctaggaaactaatccagaa

SEQ ID NO: 1781 - DNA, 1700 bp, artificial
  synthetic oligo
ctacctgggaggctaaggcaggagaatcgcttgaacacagggggcagaggttgcagtgagccaagatcatgccacttcactccagcctgggtgaaagagccaaactctgtctaaaaaaaaaaaaaagatattttcccatgctgtcttctaaaagtttgtaactacttatcacatttaggtcataaaaccactttgggccgggtgcggtggctcatgcctgtaatcccagcactttgggaggctgaggcaggtggatcatgaggtcaggagatcgagaccatcctgactaacacagtgaaaccccatctctactaaaaatacaaaaaattagccgggtatggtggcacgtgcctgtagtcccagctagtcaggaagctgaggcaggagaatcgctcaaacccaggaggcagaggttgcagtgagccgagatcacgccactgcactccagcctgggggacagagtgagactccatctcaaaaaaataataaaataaaataaaaccactttgagtttgtttttgtgtacaatgtggggttgagattttatttttttcaaaataataaccagtggttccaacaacatttattaaataaatcatttccacactgatcatgtattaagattttctttacacgtggtttctgggctctttgcattctgtcccactggtctatttttctctgtactgccttaattactacagcttataagaagtgctgccatcgggtagggtatattgtactgctttaatattgtcttgcttattcttggttctatttagaattttaattggaattgcattcaatctctaaatgaatttagggagactttgcatcattacattattaagtcttcctatacatgaacatattttatctattaacttagattttctttaatgttattcaataaagatttatacttttttgcatataggtcttgtacatcttttgttagatttattcctgggtgtctttcagtttttgtttctactgtaagctctaattggtacactattgtttttttatattgctcttatatcctaaaaccttgcttcaatattttacatatacttttgtattttctatgtggacagtcatgtcatctgcaaataataagctttgtttctccttttttgatccttactttttatttattttccttttcttactacactaattgggacctacagtacaaggttgaatagaagtgctagttttgctcctttgtatcattatggtgacgtaaattaatagttttcttaagttagatcactcttttattactgagataaacccaccttggtcataggtattttcaatgcatttttcattctgattgctagtattttgttttagattttggcatgtatgttcacaagtgaagttagcatgtaatttttctttctcataatatctttgcctggtttagcatagaggttatgctagccttataaaacgagttgggggagatttaatccaacagtttatatagtattgagattatctgttccttgtatatctgatagaattcacctatacaaccaactatctagcaggtaggtggtggttgtttgttggttgatagattttaaccactgcttcaatttagttcacaaacataagtctgttcagttttccccattttttcttgagtcaattttggtaaattttagctttatataaaattatccatttaa

SEQ ID NO: 1782 - DNA, 1250 bp, artificial
  synthetic oligo
agctccaattacacactgtttataagaaatccacttttaatataaagacatagacatattaaaagtcaaaggtatggtggctcacacctgtaatcccagcactttgagagcctgaggcgggaggattgcttgagcccaggagtttgagaccagcctgggcaacatagtgagaccccatctctacaaaaaacttaaaaataaagtaaaaagatagccacagatatactaaaaaaacaaaaaacaaacaaacaaaaaaacaaaaaaacactgaacacaagaaagttggggtagttatatttctatcagataaagcaggtttcataacaaggaatgtcatcaagaataaaatggggatcattctgcgaccggcactccacaggtcagatggctgcaaagcagtggcggaggtgaccatagccacataatgtccatagttcgtttatccgtccatgccaaatggattatggggaaggtgactgggacaaaaatgcaaaagactgctaaagtgagagtgatcaggcttgttctggatccccatttattaaagtattataataagcaaaaaacgtactttgctcacaatgcccttcagcagtgcacaattggggatatcgtgcttctcaaagctttacctgttccacgaacaaagcatgtgaaacatgaactggctgagattgttttcaaagttggaaaactcgtagatcctgtgacaggaaaaccttgtgcaggaactacctatctggagagtccattgagttcggaaaccacccaggtaagcaaaaatctgaaagaactcaatatctcttcagcacagtgaaggaagaatggaagaagaagccaaagggaaagatttacatgtttgtttattttatggaaaaagaaatttttctaagtttcatcacaaactgtgtccaatttctcttgtggtatttatgaaatagctaaaagcaaatgaagtaaagggcatattatggtttttcacaaaggtttatggtcatgcttcaaattttcttttcagtgaacatactttcacgttacactaagtgtgtctagcggtctgttgcgttttgtaagctcactgttttagaaggttttgttttcgttttttgagacagggtctcgctttgtcgcccaggctggagtgcagtggtacaatcttggctcactgcagcctcgacttccctggctccagcaatctttccaccccagccttctgagtagctgggagcacaggagcgtgccactacacc

SEQ ID NO: 1783 - DNA, 4700 bp, artificial
  synthetic oligo
actggaatcctaggagcggctgccgggcaggggcaggcaaggcagacagatggaagagtgcccaggctgcatcatggtagcagtttgaggttctgttgaaggagggaagtgacaagctgggctgagtgacaggcatggatgagagggcagaccaggctctggagaaaacagcacatgaacccatctttagtgacagtgaactgagcagagaaatgtcactttcaggcctggaaatggccagggaggcataatagtgactcctgcagggggcttctcctcaaccgggagctgggcgtccagggcaaggtggccaggcttgtgccatctcaactacttgggaacaaatagacttggcactctatgtttagccaccaaagtcaagaccaggagccccgaagtcccatcccccaaggagctgaggagcccagatgctagaaagagggccacaggatgagcagggccagcagctgcctggcaggacatctgtcacagcccattgggcagcaaccaagaggagtgcggaggctacgcggccccatttgctgaaggggagggctgcagactgctcatctgggagagggacagatgaacccagagccagccaaggaggtcacagcccagtcagatcacaaaacaaaacaaaccaaacccagctctcattaactgaagcttggcacatgctgggcattgtgtgatgtgctgtctttggaagagctgccttaattcgtaggatagctaaagtgtaattattatgtgattacaccttattatgtaattattagacagaacccacttggagctgagagccccacagagggcacagcaggggcgtgaggtccaacaagctcaggctgtgtgtgcttctggcccagagaagacgacagcgctgggagagacagcagccacagtttctctagaaacactagaatcccaggagcagctgctgggcaggggcagatgagggggcaggtgtcattatcatgacctccactttatagatggggaagctcaggtacaaagaagtaaagtgccttatataagtcacgtagttaagtcttcaggctgagattcaaaccaggtctgtctaactttaaagcctgttttgttcactctccctggcagggctattataaccattacatgaaataaaatatgatattagtaatagtgaaggcagccgggcatggtggctcacgcctgtaatcccagctaagatgggcggatcacgaggtcaggagatccagaccatcctggccaacatggtgaaaccccatccctactaacttacaaaaaaaaaaaaaaaaaaaattagccaagcatggtggcgcagtcctgcagtcccagccactcaggaggctcagtgaggcaggggaatcgcttgaacccgggaggcagaggttgcagtgagccaatattgcaccattgcattccagcctggcgacagagcaagactctgtgtcaaataaataaataatagtgaaggccaggtgcggtgcctcacgagtgtaatcccagcactttgggaggctgaggcaggcggatcatttgagatcaggagttcaagagcagcctggacaacatggcgaaaccccatctctactaaaaatacataacttagccggaccccaggaggtggagtttgcagtgggctgagatcgcaccaccgcactccagcctgagtgacagagcaagactctgtctcaagaaaataaaaaataaaaaaaagaaagaaatgggccaggtgcagtggctcacgtctgtaatcccagcactttgggaggctgaggcaggcagatcacttgaggccaggagttcaagaccagcctgggcaacatggtgaaaccccatctctactaaaaatataaaaattcactgggtgtggtcgcgggtgcctgtaatctcagctactcgggaggctgaggcgggagaatcccttgaacctggttggtggaggctgtagtgagccaagattgtgccactccactgcactccagcctgggtgacagagtgatactccatcttaaaaaaaaaaaaatggcagggcgcagtggctcatgcttgtaatcccagcactttgggaggccgaggcgggcaaattacctgaggttgggagttcaagacaagcctgaccaacatggagaaaccctgtctctactaaaatacaaaaattagccgggcgtggtggcacgcgcctgtaatcccagctactaggctacttgggaggctgagggaggagaatcgcttgaatccgggaggtggaggttgcggtgagccgagatcgcaccattacactccagcctgagcaacaagatcgacactccgtctcaaaaaaaaaaaaaaaaaaaaaaagaatcttctaacctaaaagttggaaaagcccctagaagtgatgtactccaaccctcttttgtatgcaggaattcctccatgcagcctccaagaaaatactgatccagtctctgcttaagtatctccagtgatgaggaacttactatttcccaaagcagccatttacattttaagattcctatcatggttagatagctcttaatggaactgcgccaaaatctgcttctttgtcaatttcacccaggggaccaggctctgtgctgtgggaccacagagacgcacagtaatatcaactgtcaggtgctttgaagatttcaagcactctcctttttttttttcttttttttttgagacggagtctctctctgtcgccccaggctggagtggagtggcgtgatctcagctcactgcaagctctgcctcccgggttcacgccattctctggcctcagcctcccaagtagctgggactacaggcgcccaccatcgcgcccggctaatttttttttgtatttttagtagagacggggtttcaccgtggtctcgatctcccgaccttgtgatctgcctgcctcagcctcccaaagtgctgggattacaggcgtgagccaccgcgcccggcctcaagcactcttttacagaccaccccccaccaccactgacctcacaacacacagtgaggaaggtattgtcctccccattgcaccaatgaagaaattgaggctcagggagacgagatgacttaccaaagggagcaggcctagtaaggtgcagaactgtgaattcagctgagggttcctgagtccaaagcccacactctttctacacctcctctcttccttgagtcccctccctctcccccatgggccagctcttcagttttttaaaggcagctctcatgttcctcatgagtcttctcctcctcagctaaacattcccagggctttcaaccatttcttatcaggagtcccatcactccaaaagctggatgggctccagaaactgagcacaatattccaggtggagtctggccggtcctgtgcagagcagacctcttgtgccctctcccctttgctctggacactgtactgccattcctgcagcctgtgttggtaggaatcaaattcctgtattggtaataaagtctcatcaatctgtcgacttacttatttttcactcataaatatgaataatttgcatgtaagtttggtctcttgttcctttgcaaaatcttcagtccccaggagccctgagaaacaagtgttatatgagcacagaaggagatgcatgaggcagcccggacacttaattatactttgaaatgtgtggagaagtgtgaaacctacccagcttgctagatcaggcatgtgggccctatctgtctttggaaggagtgcatcctccctctggatctcgatgaatgaaaccaagttgagttattgcatccgcatggatttccagcagctctgagcgtctggcagacaggaaacaaatcaagtgactattcttcccagaccgctcttgccaaactggctgtcaggggccataggaacagaactcctcatgatgccagctggccaagtgaaacagtggccaggggtagattcttccctgcaccttaagggagatgccaaacttccaaaaaaatgggaaccaccttgtgataggcactgctgagcggcaggtttcagggtcttagtatacccagtaggcagctcaactgtcctggcgaggccaggcagggctctcatgcagagatggtgtgcaaatccgttaacaatggcaccaggaccagctgcaatgctctctctccctgctgtttgtgggcaccattggccacccactgaatgaactgacccatggatagtgtcttcttttttttttttttgagatggagtttcaatcttgtttcccaggttggagtgcaaggcacgatcttggctcactgcaacctctgcctcccaggttcaagcgattctcctgtctcagcctcccgagtagccgggattacaggcgcatgccaccatgcccggctaatttttgtatttttggtagagatggggtttcatcatattggtcaggctggtctcgaaatcctgacctcaggtgatccacctgcctcggcctcccaaagtgctgggattacaggcatgagccactgcacctggcctggatagtgtcttctcttgagagcccgtgctcagcttgagatcccccttgtaccctctaccaacctgcacaaaacccccagcacatcaaagggaccacactgttagcaaactaattgtgagagactgcccacacctgccttgataagtggaaacagaaacagggtttggccacagaatgcac

SEQ ID NO: 1784 - DNA, 1550 bp, artificial
  synthetic oligo
agctttataatagtaatatcttgttgttgggaaatgtcagtcctctcactttattcttattcttgagaattaatttggcaatttctgggtcatttgattttttatataaactttaaaatcagttagttgacttccacaaaatgatttgcagggattttgatgggaattgcattcaatctacaggtcaagttgggaagaagtgacatctaaacaatattgagtcttcctattcgtgaacatagaatctctcttcatgtatttatttatttttattaaattttttaccttgcagctcaaaggatctccatttagatctttgatttatttcatcagagttttgtagttctctgcatatagatattgagatataacacatattttgttatgttatacctaagtatttaattttttggtgctaatataaatggtattgtgtttttaatttcaaattccagttgctcattgctgacatataggaagatgattgacttttgtatattaaccttgtgtcctacaatcttgctataattgctcattagtttcaggagtgttattttttattgttgttaattccttgggattttctacacatataatcatgtcatctgtgaataaggacaattttatttttttcctctcagttcatatactgtttattttattttattttattattgcattaggcaggacttccaggacaattgtgaattggagtggtgagaggtgatgcctttgccttgttcctgatcttaaggggaaaacatctagtttctcaccattaagtgtaatgtaggcatttttagatgtccttatcatggtgaggaacttactctctcttcctgggtttctgagagttcttaacatgaatgggtgttggattttgtcaaatgcttttttctgcatctgttgatatgatcatgttatttttcttctttagcttgttaatgtgatgggttacattaattggttttcaaatgttgaaccacctttgcatgcgtgaaataaattccacttagttgtggtgtataatttttttgtatacattgctgaatttgatctaacattttgttgaagattttacatctatgttcatgggagatgttcatttgtggttttccttgcttgtaatgcatttgtctgattttgatatttgggtaatgctaacctcagaggatgagttaggacgtatttcctatgcttctattttttagaacagattgtagagaattagtataatttcttccttaaatgtttggtagaattccccagtgaaactatcttggccaggtgctttctgttctggaagattattgattcaattaaaaatacatatagatgttgagattgtctgtttctccttgtgtgagttttagtagattgtatctgttgggagaaaagctgagtgtagggagaaaagctgagtgtagggagagaagctgaggcagggcttgcatgtctgctagacttgctggctccttacttctagcactcccattatcccaagtagccatatgtttttcattcacttgatacactgtttcctttcaacc

SEQ ID NO: 1785 - DNA, 2200 bp, artificial
  synthetic oligo
aattagaaagtagacttgagaaaatgtttctcatcttcctgcattcaaataattattccacttttcacaagctatcagtttgctttttccctagctaccatgacttacatgtagtattaacacattatgccaacaagaaacgtgatgtcagaattgggaagaatgctttttagcttcctggctcatactagtcattctagttacctccagttatccctagatacctacttttttaggtatcactacttttctataattctaaagcaacagtccaccaaagaataaggatctagtatataagactgtgcgtttcaggcaaactaaaatacacaaatgggacttcattaaactaaaaagcttctgcacagcaaaagaaataatcaacggactgaagagacaacctgttgaatgagagaaaatatgtgcaaactgttcatctgacaggggactaatatgcagaatatacagggaactcaaacaactcaagtggaaaaacccacaaataatctcatttaaaggtgggccaaaaacatgaatagacatttctcaaaagaagacatacaaaaggtatacgaaaaactgctcgaattcgttaatcatcagagaaatgcaaatgaaaaccacaatgagatattatcttatgccactcagaatagctattattaaaatgacaataaataacagatgttactgagtatgcagaaaaaaggtaagtcttatacagtgttggtgggcatgtaaactagtatagccactatgaatgacagtgtagtgatttctcaaaaaactaaaaatagaattaccattcgatccagcaatcccaacactgggtctacccaaagggaaagaaatcaatatatcaaagggataccttcattcgcatgtttattgcagcactattcacaatagcaaagatacggaagcaacttgtgctcatcaacagctgaatggataaagaaaatgtggtacatatattccacagtggaatagtattcaaccacaaaaaagaatgaaatcatgccatttgcagcaacatggatggaactgcaggtcattaccttaagggaaataaaccaggcacaaaaacacaagtatcacatgatctcacttatatgtgggagctaaaaaatgtggacacatggaggtagagagtggaaaaatagataacatagaatggaaagagtggagggaggggggatgatgaagagaagtcggtggaagggtgcaaacatacggtaagatacaaggaataaattcaatgtctgatagcagagtagggtgaatatacttaacaaaaatatacttgggtgagggataccctaataccctgacttgacactatgcattaaatacatgcaaccaaatttattctgtatcccctaaactggtacaagtacacatgtctcacgcctgtaatccaaggtactcaggaggctgaggcaggaggattggttgggtccaggagttcaagaccaacttgggcaacactgtctctagaaaagaaaaaaaaaaaactgtgcatttcaattttgaccacaaacgcatgttccaactatctttagttacctctagtaacctcgttgaataagtatcaccagctatccatagtattagctgattatgataacaagaaaccagaggttagagtggtaaatcatgatttttcagatttgtgccttcaaatattttttctttttttttttttttgagacggagtctcgctgtgtggcccaggctggagtgcagtggcacgatctgggctcactgcaagctcagcctcgcgggttcacgccattctcctgcctcagcctaccgagtagctgggactacaggtgcccgccaccacgcccggctaattttttgtatttttttttagtagagacggggtttcaccatgttagccaggatggtctcaatctcctgacctcgtgatctgcccgcctcggcctcccaaagtgctgggattataggtgtgagccaccgcgcccggtcgccttcaaatattttttctaattacttctacttaattcaaatttactagcgacctacataccaccagatatctgtagtacaaactcattttatcaaggaaagataagaatttcgtcttgtcgaggattgctttccaggttccaggcttctctgaggttttctagttatttctagttatctccagttcagtagttaccatgtactcctg

SEQ ID NO: 1786 - DNA, 13150 bp, artificial
  synthetic oligo
caaccatcttgtagctggtttcctctctatcctcctggaacaggagaaaggagagacttacctgtctagcacagtgggcgaagtgagtgggtgtacctttatgggcctatgaaaatggtttattttattaaatgggtctgatggcaatggtgtttatcatggcaaaaaaaaaaaaaaggataaataatcccaatattcaggaaaccaactcattccaaggaacaattcttatttttaattaattaattaattaattaatttttatttatttatttttttagagccagggtttcattgagtcacccacgctggagtgcagtggtgtgatcatagctcactgcagcctccaatgcctggggttaagcgatccccccacctcagcctcctgaatagcttgcacgacagcgcatgacaccatgcccaactattttgttttttatttttttagagatgggtttttttctattttgctcaggttggtctcaaactcctggtctcaagcgattctcccgccgaagccacaggaggagctagtatttacaggcgcgcacaaccgagcccagaatcgtacgggggcacgatttttaaatttttttgttttgaaatacagggtctcgctctgtcgcccaggctggagtgcagtggctggagtgcagtggcgttatcatagttcactataacccacatcctgcatcgtcctgaggcacacttcttaagggaaaaacatagaggtcccaatcggccctggctcttttttatttgacatttatcagtagggagcaaaaggtcagaatgatagttctagacaaagagtaggaaatgagaagcaggaggaggaggatgggtaacagaagtgggtgaggatggagggaagacgggagctaacccaagtccccagcgcctgcccagcacagtgaacactggcacttctgcagagggcttgcaacctaaggcgccagagcccagcatagcttagcagacattgcatgctccacagtcgcgtctagcgccaaaggaagggccacttgcagtgtaagccttctgggatgcactaaacaccaggcagggttctatgtgtactctgacgtggagtacctggagcttttgcaaggggcgtgttaggtttcttgcaacttgcacctgagcatccagagtgctctgcaaatcccagccccaaacttctgcttccacagatctcctggagagcgtggcgcactcaactttctggacattgctgcaaaaacctagcatgcagcctctgacttcatcatttcatcttaattacggtccgattcgcggactttgggtgggaacagaccagagctagagagactcatccattagttactaactacccagaggggagagcagtgctggcagtccaaattgcaaggtgcgctgccttcagcgtgcggcgtcttcgccctggagaagcattacgctggcccgcctgcctccagggccacacggaaacgtgttctgcaaactttctccaagggctcgggggctagattgtgtctcgctccgctgcctctccccctgcctcaatttcgactcctgccagacagctcagcccctccctctggcagtcaccccgcccggagtgggagtggtcaacgaagctgcaaaatggatcgcaagtccccacacacgtccgacccctccccgcgccctgaccacgaacgcatccctgacttaaccgccacactcgggccgtgagcgcctgccagcagggccttccgccacacacacacacacacacaccgcaagcagcggcgaccagggcaggagcccactccccgccacctgcaggcgtcggacccgaagtccacgagccggaactcagagcaggagccgaaggaccccagcgcagaatccgtggaggcgcacggcttcatccaccgcgctcccagatggggtcccagcccagatccggccacgaagacacaggcaaccccggcctgggtttcctgttccatgagctccaggaaggcgacagtcagtgcttgtctggggacccggaccggtgctttggggaactcccccggagggagagagtttggggaactctcccgagaagggaactttcccggagaggggggcgtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcggtaagcggcttgctctggagcttcccagttcccaggactctggggctcttccctggacgcctttggctctacccatgtctctttaccaggctccagtgccaagagctatttagggggctcaaggccactggctcagggccgctcttgagctgtgggatgcgggcgatagcaactgggcatcaaggtatttttcaagcagtatagatacgaatcaagttaaatatttgcattaaaattattaatcttcgggctggtgctgtggctcatgcctgtaatccgagcgctctgggagggcaagtcaggaggatcacttgagtccaggcgttcagggccaggctgaccaatatactgagacttcatctctacaaaaaattttgtaaaattagctgggcatattagcagcacgcacccgtaatccaaggtgctctggaggatcgcttgagcccagagttcaaggcttcagtgaactgtgatccggccactgccttccagcctgtgctacagagctagaccctgtctctaaaattagatacatagataaattacatgaatagatgacagatagatagagatagaaaaatcttgaatcctaagtgttttagccctctctgaaattctgcacacaaaggaaaacaatcccctacctaatgcaagcctggggctatttttaggtatcacagaaaaatgtgcaggagcagttgggaggctagacattttcaaactggtatgaaatgttcataggtgtatttcgtttcatccacaattccaaatactgaatttttgtagttttctttcccagaaagcagcttgcaatctgcatggatgtgagtgaagccgaagtggaagccagtaagcctgatgaaagcaattggtcagagtagccactctctgaaacctgcctcagtccttgaatacctttgtcctacacattctccaattggcctgtttttgttgccttttctatgtttgccaagtgagttttgaactttagcgggggaataatgggatacataaaccttagcctatggaaatttcccattaccagagggaatatgctttctaatgcgaaacagaactaaactgttacttctatttcctgtacaaggttaagtgtaaataaagttccattccttctaacaatggtatcctttagagaacacttctgtgtggagttatgttgggactgagtctgacttgaggagtttgcaaattaatgcaccaaggacccatattgtgagaaggttcaactgtatttaaaatatttaaaccaggctatgttcttagctaaatgaccaaatttataaatattcaggcattgggataagggaataagttacatacagaaagaacacattatatgagtaattaatgtatgtttagtttcactgagacttatggggaggacatagcttaaaagtccaagtgcctggtagtcctgctgttgtttttaagggtctgatgaagccatgtagaaagtggcagcccgcaattttgattttctccaatacttttatttgtaagccggaatacactgctaatatacttgcattacactgggggtgtgggggggcaggtttgcaaacaggaaatttgtttaaaaattggaataaaaaagaacaattttgaaaaagttttcacttaactaagaagggtgaaaaggttaaagaaaaattgcatacactcaaatatataccttgaaggtatggcacaaatggagctctatgagggaatattctctttaggaatttctgacaactaagaagttttttttatgttactgttttaaactggtgggttttatgtaatttgtttggtggtggggtggggcacgctcaatttagaccaggttcttacctgtgctaatttgaaatggtttttcattttcccaggcagtggtgattaatttgtaagtcatgagatcaagaaattactaagattacttcagtattattgactgagtatattttcaaaacaaagagaaaatccaggattaggttatgagcagtgctgtgcagttcatgtgagtgcagtgatgggccccccatgactaagccttttttttcagaccatctttttcactctcaagagttttcagaggatgaagtctggcccagtggctcacgcctgtaatcccagcaatttgggaggccaaggcaggcagatcacgcgaggtcaggagttcgagaccagcctggccaacatggtgaaaccccatggtgaaaatacaaaaattacctggacttggtagcgcaccactgtagtcccacctactaggtgtagcatgaggcaggtggatcgcttgaacctgacaggcagaggttgcagtgagccaagatcgtgccactgcactctaaatctgggtgacagagcaagaccctgtctcaaaaaaaaaaaaaaaaaaaaaaaaatttcagaggatgaatggccccttaggcatcctttacgaaacctgattaaagatccagcctgctcctattgatgtagttacttcagactgaagatgggcttttcaaacggggttgcagtgtgtaaagatccggccattgcactccagcctgggtgacagagtgagactccgtctcaaaaaccacaacaaaaaagaaactttagaaagcaaaacccccaatttttttgattactatagaatgcagaagctcctggactcttcccgagattgtgttcataacttttcagctgaaactaacatctgtgaagaccatctatcttgggtgaacctattttctggtaaccagtgttaaatattttttaataaataaaaattttaaacttgtattagaacagttaatttctcgtctttgccttttttccttttttaatatgtttttaaaatcccttttgagagatgagatctgaatatgttgcccagactggttttgaactcctgagctcaaacaatcctctcacctcggtttccagaagtgccgggattacaggcctgggcgatcacacctggcctggttgttgcctttgcaatatttgaagtacattttaaaatacatgcgttttgtgggattacttttaaaagaactctctgttttgaaatttagattgagtggaaactattatctaaagcattattttttactatttcctctgccccacgccttagttcttctggaactttgaagaactagagagacattaaaaatagtacatatgtcggtgagttgccgtggctccgttcaagcgatgccggggggtggattgcatgagcccaggagtttgagacaagcctgggcaacatggtgaaaccacagctccactaaaagtacaaaaatcagctgggcatggtggtgcatgcctgtagtcccagctacaggggaggctgaggtgggaggatcccttgagcctaggaagtggaagttgcagtgaggtgagaccgggccactgcactccagcctggacgacggagtgagaccctgagtcaaaaacaaaaacaaaacagacaaacaagtaaatacatgtctcttgaagactccatcacttatgggaaatggtattcactattcttttcctgagcatgaaaaaaatgttctgttagtgtgtgtcaaattgaatgttagtgtttactgcatgatttgtgtggagtatttctttggcttccaattgcaatatggcaaaaccatgtgctcaactgggacaaaggctagaagaggtcagaactcggtctgatggtgtcctgtggcttttatttctatagattctgtagttctgtttagagggtacctacagcattgaggaagctgatgtttaaaaagaacaggtgccaccttgggaaataagaaatgttggtttctggccaggtgtggtggctcacgcctgtaatcccagcactttgggaggctgaggcaggcggatcatgaggtcaggagatcgagaccatcctggctaacaaggtgaaatcccgtctctactaaaaatacaaaaaaaatagccgggcttggtggcgggcgcctgtagtcccagttacacgggaggctgaggcaggagaatggtgtgaacccgggaggcggagcctgcagtgagcccagatcgcaccactgcactcccgcctgggtgacagagtgagactccgactcaaaaaaaaaaaaaaaggaaatgttggtttcaaaattatctggtgaggatggcagtgggcatacacaggcgcattcctagatgttccccaattcagccaggcgctgggggctctgggtatcaataatctcctctctgtgcagaagtcccacattacatgcaactgctttgctgacatttcatatccacaactgtgaagttcgcagagtgagatagtggacaacatagcaaaaaatgcatgctttcctaagaaaacagagcctcgctttacactgggaacacatacgtgctgtgaaactggactttgatttaacccctgcgagaggaaattctgatggaactgtggcacttatcttagtaatcacttcatagtgcagccttggtgctcacaattaaccacttttaatagccaacgagaagtcttgcattgctagagattgctcataagcaaaggctgtattgagaagaacttaatgtttctttaaaaatgggcctggcttccttcaccctcccatttttgtttttgttgttttctactctggtagttgcacaggaagaagacaccatgatcaaatgactgcctattccagtgaatgatgagtctagattactgctcaggggaccatctccttgattccagtgccaataaccccaaagatgccctttctatttttaattagcaggaattcgagatctcttaaggatgaagagagcaacaaaatacattggacagtgtgattgtccgttttgaattggggaaggtgcaataatatgccttctgggctggggatgggggagaaaagggagaacagcttcattctggctttggtggagtctcatctcatgattcttctgaagcagcaggacctttgggccagaatgactcctattcccctgtgtcccccacaaaaagggagggcggtggacagaatttggagcatgtcgaatcaatgcttagctgttgccttcccataaatactgagtagccgcttaggaagcttcccctagagtccggagttgggcatggatgtccctattaacattgatgggtccctattctgtctgaaaaaaagggccaaactagttctaaattcactaaaagtcacccgcaccagctctgcagctcctttccatcactgccctcacacaaactgcagagcgaggctcataacctcatcctggattttgttttcgttttggaaaattctctcttaataaaacttaagtaatcttagaaatcttttgatcccatgacctacaaattaatcatcactgcctgggaaaatgaaaacgtatttcaaataagcacaggtaagaatctggtttaaattgagcgtgctccccatcaccaaacaaatttcataaaacccacctctttagacagtcccatcaaaataattccttagttgttagaaattcctcaagagaatattcactcataaagttcaatttgtgccatttcttcaaggtatatatgtaagtgtatgccattcttctttaaccttttcacccttcttaggtgactggaaccttattcaaaattgttcttgtttgttccaatttttaggcaaatttccagtttgcaaacctgtctccccccgccccccactgtaatgtgcgtatattagcagtgttttcaggctgacacatcgaagtattccagaaaattacaatttcaggtagccactttctacatgtcttcatcagacacttcgaaaaaatagcaggaccaccaggcacttggacttttaagctatctcctccccatcagtctcagtgaaactaaacgtacttaattactcatatagtgtgttgtctgtgtgtgtgacttagtcccttaacccaatgcccgaatatttataaactcactcactgagctaagaacctaacttggtttaaatattttaaatacagttgaagcttctcacatcgtagctctttggtgcattaatttgcatacttctaagtcagactcagtcccaagatacctccacacagaagtagtctctaaaggatactattgttagaaggaaccgaactttgtttattcttaattttgtacaggaaatagaagtagcagtttggtatgtatagttttatttttccattagaaagcatattccctctggtaatgtgtaatttccataagctggggtttccttatcccatttttcaccctctaaagttcagaactcactttgcaaacatagaaaaggcaacaaaaataggccaacttgagaatgtgtaggacaaaggtatcaaaggactgaagcaggtttcagagtggctactctgaccagttgctttcatcaggcttactggcttccacttcgacttcacttacatccatgcatattgtaagctcctttctggggcagaaaaccacaaacgttcagtatttaaactttttcagaattgtggatgaaatgaaatacactgatgaacgtttcataccggtttgaaaatgtctatcctctcaaccgctccagcatatttttctgtgatacctagccccaggcttgcattagggatggctgtccttggtgtgcagaatttaaaagagcactaaaacactcaggattcaagatatctctttctatttaactgtccatctatctatttaattttagagatagggtctagctctgttgaccaggctggaggaggggtgacacaatcatggttcactgaacccacgaacacctgggctcaagcgatcctacggagtagctgagactacaggtgtgtgccaccatgccggtctaattttttaaatttttaattaattaattaattaattttttgagacggagtcttgctctgtcgcccaggctggagtgcagtggcgctatctcagctcactgtaagctccgcctcccaggttcacgccattctcctgcctcagcctcccgagcggctgggactacaggcgcccgccaccacgcccggctaattttttaaaatatttttagtagagacggggtttcaccgtgttagccaggatggtctcgatctcctgaccttgtgatccgcccgcctcggcctcccaaagtgctgggattacaggcttgagccaccgcgcccgccctaattttttaaatttttacgtagcgacagagtatcattatattgctcaggctggtcttgaacgcctggactcaaatgatcctcccgccttggcctcccagagtgctaggattacaggcatgagccaccgaaccagcccgaagattaacaaatgttaaggcattattttaaaaatcaagaccaatgaaaaaaatccacagtaaccaaattgttaaaatgttcaataaaggcaagatccaaccgtgtaggactcactctcctcaccctgatgtccatcgcaattccaacaaaacatttccaaaacaggagtctggccaaagtttcctggcttgattcgtttctataatgcgtgaaaaaataccttaatgcccagtaggcatcgcccccaccccacagctcaagagtgacctactccagtggccttgagccccatatgtagcttttgactctggaggggagggagcgagactggggcagggccaaaggcgtcccgggaagagccctagcgtcctggataattgcgcacctctagagcaagccgcttacctagcaaacacgtcgggatactgagagcatcggaaaatgctgtctagctccttcaggtgcaacccactgaatgcactgggggagaagagatgctgctgatcttctggctgcagctccgaggaagaagagtcctgggcggactcctcaggctgctgctgccagggctcctggtatccaccgccgcccttctggttctcgtcgaacatggggtccgcagctcccgcgcagacgtgactttcttctgcttctgctccctgctcgggttcggactcttcttcttatcctctcctcccacttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactcgcggcctgagaaaggtggcacagcagcttcccgcccacgcgcctctctccgggaaagttcctttcctagagttgaacaaatcaccggtccgggtccccagccaggcactgaccgtcgccttcctggagctcatggaacacgaagcccaggcagaggtagccggtgtcttcgtggctagatctgggctgggacgcgatctgagagcgcggtggatgaagccctgcgcctccgcggattctgcgctggggtcctctagctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtcaggggcgagctcctggtcagggcgcggggagggggtcgggcgtgcagggaacccgcgctccagtttgcggcttggttgaccactcccaacccgggtggggtgactgccaggaggaaggggccaagctgcctggcgccaacagattggggcaggggaaggggcggaggagctagacccaatagagaaagttaacagaacatgtctctgtccagccctccaggcacgcgggcttgcagaatgcttctccagggcgaaggcgctgcaagctgaaggcagtgcaccttgcggcgtgggttcctggcaccacgctgccctctgactagttggtgactaatgcatgagactctctggttgtgttccgttcgcactcaaagtcctcgaatcggaccgtaattaagatgaaatgatgaggtcggaggctgcatgctaggtttttgcagcaacgtccagaaaattgagcacgcaacgctctccaagggggtctggggaaccctgagtttgggcctgggtttggcagaccgctccggatgctcaaatgcaagctgcaagaaacctaacacgccccttgctaactaattactccacctcagagtacaagcgtagaaccctgttcggtgtttagtgcatctaagaagggttacactgcaagtgaatcttcctttggctctagacgcgactgcggagcatgaaatgtctgctaagctatattctgctccagagcctcaggttgcaggccctctgcagaagcgggagtgtttcgtgtgctgggcgggcgctgtggacttggcttagttcccgccttcccttgctcgtcatcaccttctcttacccaccctcctcgtcctcctcctgctttccctttcctactctttgtctagaattatctttcagacctcttgctccctactgataaatgtcaaataaaaaagaggcagggtagattgggagctctatgtttctcccttcaagaagtgtgcctcagaacgatgaaggctgtgggttacagtgatctatggtcgccccactgcaatcctgccactgcactccagcctgggagaaaaagagagaccctgtaccttaaaaaagaaaatggttcctcgggatgatgctgggcccggtggtgcgtgcctgtaatcctagctactccaggaggctgaggcgggaggatcgctttagcccaggagtttgagaccagcctgagtaacacagcaagacccccatctctcaaaaaataaaaaacaaaaatagcgggacgtggtggcacgcacctgaagtctaagctactcacctagctgaagcgggaaaatcgcttgaacctaagcgttggagactgtagtgagctatttttaccagcggaggctgttcagtttgttggcgttttgaacaaagaattggacaaaactcgcaaggaaacaatgaagcaacaaaagcagagatttatggaaaacgaaagttcactccacagggtgggagcaggcctgagcagccactcaagggccccgatacagaatcttctcgggtccaaataccccctagaagtttcccattggctactaggtgttcaccttaggtaaatgaagtgatgactggcaatcagtctaaatggttgtggaaagcaaccaatcagaggctgaagtgaagtcacaaagttccattcctctgcaaaggtctgattggttccaaaaagcaaccaatcagaggtacttttaatttcccgtctgcccagcagataaggtgggggtttgcaaagggagtagccacaggtgcttttgttacttaggcgtgggaagttagggctttcctttcaatttagttctaggatgtcagcctgaaacggcattaggttcactgcttccagaccctattctcctgcctcactatgatcacaccactgcactccatcctgaactacagactgagaccctagctgtaaaacataaaacaaaataa

SEQ ID NO: 1787 - DNA, 1500 bp, artificial
  synthetic oligo
cgccactgcactacagcctgggcgacagagcgagactccatctcaaaaacaaaaacaaaaacaaaacaaagcaaaaaaaccagtaataccaaaaactccttagttgttagaaattcctcaagagaatattccctcacaaagctcaatttgtgccgtatcttccaggtatatatttgagtgtatgcaattcttttttaaccttttcagctttctaaggtgagtggaaccttattcaaaatttttcttgtttattccaatttttaggcaaatttctagtttgaaaacctgcccccccacacccccactgtactgcaagtatattagcagagcattcacgcttacaaatcaaagtattccagaaaatttaaattaagtgctgccacgttctgcatggcctcatcagacacttaaaaacaacagcaggaccaccagccaagagtacttttaagttatgtcctccccatcagtctcagtgaaactaaacatacattaattactcatttagtgtcttctctctctgtgtaacttactccctttccccaatgcctgaatatttataaattcagtcatttagctaagaaggtagcctggtttaaatattttaaatacaattgaaacttctcacatcctggctccttggtgcattaatttgcgtagttcttaagtcacactcagtcacaacataactccatacagaagtgttctccaaaggttaccattgttagaaggaattgaactttatcttaattttgtataggaaatagcagtagcagttcagttctgtttaattttatttttccattagaaagcatattccctctgttaatgggaaatttccacaagctaatgtttacatatcctacttttcaccccctaaaattcaaaactcacttcgcaaacataaaaaggcaacacatacaggccaattggagaatgtgtaggacaaagtatccaaggtctgaggcaggtttcagagtggctactctgaccaattgctttcatcaggcttactggcttccacttcagcttcactcacatccatgcatattgccagttgctttctgggaaaaaaaaaccacaaaagttcattatttggaattgtggatgaaatgaaatacacctatgaacatttcataccggtttgaaattatctatcctcgcaaccgctccagcacatttttctgtgatacctagccccaggattgcattaggtaggaatggttgtcctttgtgtgcagacttttttttttttttttttttttggacagagtctggcactgtcaccctggctggagtgcagtggcacaatctcggctcactgcaacttccgcctcccgggttaaagtgattctcctgccacagcctcctgagtagctgggattataggcacccgccaccacgcccagctaatttttttgtatttttagtagagatggggtttcactatattggccaggctggtcttgaactcctgacctcatgatccgcctgcctcggcct

SEQ ID NO: 1788 - DNA, 8000 bp, artificial
  synthetic oligo
ggaggagagagctggagagagagagagagatcagggcgtttggcccagacacagggcagcctagacccgtggctgagagagacagcgcagtagcctcgggttcacgctcctctctccgggaaagttgctttccaagagttcaccaaatcaccggttcgggtccccagacaggcactgaccgtcttctttctggagctcatcgaacaggaaacccaggccgaggtcgccggtgtcttcgtggccggatctgggctggaacgccacctgggagcgtggtcgacgaagccgtgcgtctccgcggattctgcgctggggtcctctggctcctggtccgagttccggcgcgtggacttcgggtcggacgcctgcaggggacagggagtgggctgctgctcaggacgcctccggtggctgtgtgtgtgtgtgtgtgtgacagagagagagagagagagagagaggagagggagagagagagagagagaggagaggggaagagagagagagagagagagagagagagcgagccttgctggcacgcgctctcggccgggcgtggccgtaaagtcaggggcgcgctcctggtcaggcgcggggaggtggcgggcaggtgtggggaaccgcgctatattttgcggtttccttgaccactcccaccctgggcggggtgagtgccagcaggaaaaggctgagcggtctggtgggaacctatttggggcagggggaggggcggaggagcgagacccaatctagctccggagcccttggagaaagtttgcgcaacacgtctctgtccagccatccaggcaggcaggcaggccagaataatgcttccccaggagagagccgaggcaagctgaagtcagtgcacctagcggtgtgggctcccggcaccactctccccactgggtagctggtgactaatggatgagcctctccagttctgttctgttcccacccaaagtccgctaataggaccgtaattaagatgaaatgaagaggtcgaagactgcatgctaggtttctgcagcaacatccagaaagttgagggcgccacactctccaaggggtctgcggaagcgggagtttggggctgcgattttcagggcactatggatgctcagatgcaagctgcaagaaacctaacacgccccttgcaaaagctgcaggtactccacgtcagtgtacaggtatagaaccctgcctggtgtttagtgcatctaagaaggcttacactgcaagtgtcccttccataggctctagatgagactgcggagcgtgcaatgtctgctaactatgcaccgctcccacgccttaggtttcaggctcgctgcagaagcgcgagtgctccatgtgctgggtgggcactgtggacttgggttagttcccaccttcccttgctcctcatccccttctgttacccaccctcctcgtcctcctcatgcttctcctttcctactctttgcctagaacgatcattctgaccttttgctccttaatgataaaatgtcaaataaaaaagagccagggcagattgggagctccacgtttctcccttcaagaaatgtgcctcaaaacgatgaatctgtgttcagtgagctatgatagcgccacttcactcaagccactgcactccagcctgggcgacagagtgagaacctgtacctcaaaaaaaaaaaaaaaattgtgcccccagacgattctgggcccggtggtgcggacctgtaatcctagttactcctgacgcttttgcaggagatcctttgagcccaggagttcgagagcaacctgagcaacatagaaagacccccatctctaaaaatataaaaaataaaaatagctgaatgtggtggcatgcgtctgtcatccaagctactcaggatgctgaggctgggggatcgcttgatgccaggcattggaggctacagtgagctatgatcacaccactgcactccagcctgggcgactcagtgaaaccctgcttaaaaaaaaaaaggaaaagaaaagaaataaaagtaaatttaaaaaaattaaattgttccttgaaatgagttggtttcctgaatattgggataatttatccaatttttgcataaccaccattgtcatcagacccatttaataaaataaatcaaaccattttcataggcccttgaaagtatgcccactcactttgcccgctgtgccagaaagataattctctcctttctcctgttcctgagagggcagataggaaaccagctacaggatgatgggttgaccaattgactctgaaaaaactgtcaaggaatttcacccccacagactctccctgacattaaccaagatgtctcctcctcaagctgcctcttgcagggttctgcagacctcacccttctcgtggccagacaccctgtgatgaattttggcctgggatccgttattatgtgagagacttacaatgattttaatcatggtatgtattagcccagctatgacatctgttagaattggagtcctgtggtgtctcacatctgagatttccatgacttgcttcagcgctttctcagcttcagtagtcatttctgtgctcctttggtgagtgttacctaccggagcaccaaccaaggtagtatttactttaaaattttagttacattgattcacttcttgcaaatgttatgttccttattgagcgtcagccaggtaaaaataggcacaaatgatgggtttgatgtcctaaatttatgaaggcagggaccctggagccagactgctggcatctgcattacggcattgcttgtcatttgctagctagctaacctggtgagtttgttctcttgtgcttcaattttctcatctgtaaaatggagtaataataatacctacctcatggagctgttgtggagattaactgagatgatactaatggtagctcacacttacctggttcttactgtgttctaggcaacgatctaagtgatttgtttatgttaacatatttaatcctcttaacaaccctatacacacgttgatgtgctattactgtcattttacaggtggtgttattaagtcacggagatgttaaataccctgctcaaagtcactcacttgggaaatgtccagagctgggatttgaacccatcctctgagtactgtccctgacacagacgacgtgctcaataacctttgctattatgctataattagtgttcttttgtaattagtaaactagagataaacagaaatatatgtatcatttagctcaaaatttccttcacttgtttgaatatcgaattagtgccatacatatctagtggtacctctactctgttaattacttcttttactgtgcagaagctttttagtttaataaatgccatttgcatatttttttgcctgaaatgcacagtcttatttactatatccttattctttgttggaatgttgccttagaactatagaaaagtagtgatacattaaaaaaaaaacataactaagtgtctagggataagtggagataactggaatgactagcataagccagaaagccaaaaagcattctttccaactctgacatcatatttcttgttggcctaatgtgttaatgctatacataagtcatgatacctagggaaaaagtaaactacagacagcttgcgataagtggtataattagttgaatccaataagatgaaaaacatattctcaagtctaccttctaatttcttctggaaataaggagttaataatacagatatctgggagtacctaaagaactagttaagtagacacaagtaaagttaaatagagaactacatagtagctcattatataaaacccattttccccaaatctaaaccctaaccactcctaaccccttagtatttgcagagtatattaaaaaacacagatatattgaaaaacacagcaggcaagggtctctgcctttgcttcaggctctcagagagatgagagttattattcctggcagattgtagcaacaaccatccaggtgtatgtaaagaacattcttgcaaatgtgtgtaatctcctctgatctaacatcctatgggtaggtggagatgaggcaagaggaaaagactacagtagcaaatcatttcatttggatacttaataaattaagtaaactactaaattatttgaccagcttgcatttgtaattatatgccaaaaagtatgcttttttattttatattgaaatcatatttttttctttggagaagaatggaattggtggtgaagtgtcacaaagtctgaaatttacctgtgaacgtttcagcaaaaagcaaagaagcaaaagcacatgcacacatagctatagaaagaaaatatagcaaaatgttaacaaagtttgaacctacttggtgagtataccagtgttactgttcattctttaaagttttctgtatgtttgaaaattttcattaacaatttttaaaaaataaatggaaggtttcaacaaagtacataaacccaaaagccttacacttaacatctaaggctcaaatagcaacgaagtttgacttctacaataaacaataaagacccttggcttttatttcactaaagtattgccacattataagcattgccttaaaacgtctgctctcaaaaagacatttggggttatatggcaaaagtgtcaaagcaaggcactgaaagaccaaagaactccatgtaaagattatcctaaaccgaattgccttgggatttctaaaagtactgcaaacactacccaaggctgattttgtccacgtctagcgatttccccacctccgtccttggatgccggcattccaagtggctcacaatatctcccagccaaacacactgaaattcttagacttaagacaagtatgccacagagcagccttctgacactgcaactggggacaatcagtgcaccctcacttctctctccaccactcctcaacatcttccccaagatcctttattttaatttttttagagacaagatctcactctgttgtccaggctgcagtgcagtggcctgatcatggctcactgcaacctccacctcctgggctcaagctatcctcccgtctcagcctccagagtagctgggattacaggcatgcaccaccgcgcctggcgattgaaattttattttatttattttcttcaagacagagttttgctgtgttgctcaggctggtctccagctcctgggctcaagagagcctcccgcttcagcttccccaatagctgggactgcaggtgaacaccatcatgcctggcatcccccaggatccttgagccttaagtattgcacgcacctctcaggcagccacacccaccatcagagtgtggtcaagcccatgaaacctcaggcagccccactgagcttgctgacgatttcactttgcacaggctagggtggagtatggcagccccactgagcttgctgacgatttcactttgcacagggctagggtggagtatggcacccccttctccattccctgcagatcttccttaaaaaaaaaaaaagttttccttttattttttcattttagttctccatgtatgtatgtatgtatgtatgtatgtatgtatgtatgtatgtatgtatgtatttatcttgttgcccaggctggagtgcagtggcgtgatccaggctcactgcaacctccgcctcccaggtcaagtgattctcctgcctcagcctcctgagtagcagggattacaggcacgtgccacccatgcctggctaatttttgtatattcagtagagacggggtttcaccatgttagctaggcttgtcttgaactcttgacctcaggtgatccgcctgcctcagcctcccaaagtgctgggattacaggcatgagctactgcgcccggccttatttatttattttgagagggtacatgtgcaggtttgttacatggatatattatgtgatgcagaggtttgggcttctattgaacccatcatccaaatagtgaacatagtacccaatggatagtttttctttttaaaatttttatttatttatatattttttaaatgcaacgtagttgttattgtaagtgctcatccatttaaaaataaatctagactgggcatgcaatagctcatatttgtaatcccagctactcgggaggccaaagctggaggatcacttggcccaggagttcaaggttacagcgagctatgatcatgccattgcactacagtctgggtggcagcgtgagaccctgtctctaaaaacaaaacaaaacaaaacaaaataaaataaaataaatctatactgccttacatttttggattttgttttccattgacaaaaacattagaatcgatttttccaaagcactttcttttctcctataaactttaaagtaggtttaagatgtgcatactcaaaaatcatatgcttatgattctttaaattctttaaaaaacaaaattctgaaataatttttacaccttacagttcagcttaaaagtacatctgttgcagtaacaaagcattcaaccagcactttcctgacaagtgttaccataagctacataggctacaactgtgtttaagcacttttattatttcacaggagttattatgagctgccagttctcctatttgcacagttcattcacactttttaaagtagtttcatattcaccattttatttgcccctctcaattgccccctaaaggtgaggcacccaggagacttctcattcctattttaaagttgtggaaaccaaagtaggacgtaagctagttaccacactgggcccacaattcaagtctcatgagcctgcaattcatgcccaccaactgccgcttcatccccttaagctatctttcagggcaaagagaactctaactaaaaggatacaatagcttgattgccaaacctgcagcgacgacttctgtcaaaatatttaccccttgtggcccttggaagataatgtgctaagtgaactgtagagttaagatagcaaggtgtggggcaatactgacacccacttgcagataggtcagaaaatttctgttgtgcaacattcactccaacacatagttcacttgagcattatcatgatccagttatctggcttgtttgtgcaccctggttgatgcaaaggagaactcccacatagttctctaagtataattatagcaaatgtacaacatttgattaacatggcaattgattctattcatgaccctcagtcactgctggctgctgggaaaagactgagatacagaatgattttaaagatcaataaaattcttctccttaaaaaaaactcattaaaaaagtaaacaaaatcttccatttcctaaattagaggcaaaaagacttaactatggttcaccttgttctctcaagcttttactattaagctcagtttaacttccttcaaacagcaatcacttgtgtcataccccgcagttaattcacaatgtccagtttcttccatcatcataactgggacttcatgtcctgggagacaggacttaaccagtttaaagactttgatgtcagtgtagtggtccaaaggcattcagattataataatgtattgcaataattatcgagcagttactaaatatcagacttccctgtattattttatatatatcctaaattaatcctcaaaaatccatcaggcaggcactgttatatccactacttgacaagaactgaggcacaaagggtaagaaaactgcttaagttcacatagcaacaaatggccaatgaaggacttgagccagggccttaacgtcagccactacaccaaaactgcctagtcctcaactataatcccagatcaatcattaaacgaatcacatgaccttgggccagtcatttcatacctctaggcctccactgtaaaaagagacgcactaggtgagctttcacgtgctttcctgcttttaacgttctgccaatctctgcctggattgctcccctccagaataagtgctgtaactgctaagactaaaatttctcagtcactgtg

SEQ ID NO: 1789 - DNA, 1400 bp, artificial
  synthetic oligo
atctctacatatactaaggccacgatacatggccttaccaggatacttcttatcccctttggagttccagacatttctgatattggcaaaggccctcatttcgcttctcagaatacacaatgccgagctattgaagaaagcattcaatggaacttctaccacccctataggtctcaggcagctggtttaattggaagcataatgggttcttcagagaactctaatttaatttgcaaagtgacaaatggacaccccactgggtgtcactgttgccacagacattgattagtctaaattcatgccccctggggacatgccttccctgtaccaatgtcacacaggtccctcaaatgcctttattggccataaatggggatacctctaatgttaatgtatttttgatgaccacctcaccatgtacccatctttcttctggtcaagtgcctactttgcttcctaggaatgttctgcttctattccccccaaagttgcagtgatcaacaagtttaaactgatgtcaaaacatcaaggggtcagttgtgatataaatcctaaaattaatagtaagtgctgccttgacatctagaaaaatcaggaaggtctcaaatagcctaaccacaagttcccttccccattctgctcctactgataaggtcccctagccaaaaagctctccttatcacagggatcagacacagttgttatttatcactgagtagcaggcctcagtccctgccagcccatgtcattattcaaatgagccaatcacattcttctgtgggaaccaaggatcaccttatcctcttgatattacaaagtctgcctcccacagaccctgcttgttcactctggtcccaaacacaagcgccttgtggtcttgcatggcatgtgtcttcctcccctgggtcgtgggtatatgtgactaaaaaactgctgttgatctcatttgttcagtgtcaggtgtcttcagccatctccataaccctaggttggagatccatccttcaccaatggggtaaagaagtgattatcaaaacaaagagtaacaaagaaaaaatacactgatattgtcttttatatttactatgtagttaaatttactggtttatttgctttttcatgtagattcgagttgctatcgcctgctttttcactgtggccagaaaacccccactttaggatttcttgtaggcacgtctgccagcaacactctcagtttttgtttatctgagaatgtcttaatttctttttcatttttaaagagttgatttgctggctgtagaattcttagttgacaatacttttatttcagcacttttagtatgtcatcttactgccttctggtgtccatggtttctgatgagaaattagctgttaatcttgttgagtaacccttctat

SEQ ID NO: 1790 - DNA, 1500 bp, artificial
  synthetic oligo
agcagagccattttattcatctttgctaaagatgaatacaatttgaaataagcaggccaaaacctcactttgccttgattggaggcaagtccagtggaaattcatcaaaagtttgaattatagactatgtggaaagaaatgctgttttcatcacttcaaatacctataattattggaaccaagctgctaggactcttcagggcacccactttaatgaatagcaaagaatgatttgtacttaggacatcaactgttgcccagaggactctcaagcaattttccctctgcaatacttttaactccactcccctgtattcttgttcatggccatcatttgctgagcaagcccttccatcggagatgctgtaaaggtaaactgcaattagacccctgacacaatcctcactgactccaaattggtgaaatctgaataagcaaggacatactgaatctgaggaattttttaaagagctatttcgtggttgggtttgttctggttcatgagtccaagcagggaggaagagcttgttggcaagcactgaccactctcatctgtgattgctctgcaggcctgatcttactcatttacttcttcttctatgcctccttggctgctgtgatcaccctctgcatgtacacactatttctgaccatcagtccctatataccaaccttcacggagcgggtaaagcctcctggtgagtgtgcccagatgccctgtgttgtcagaacttgctggacagaaatatgcttgcacagcatgttcagcctcaattaactttggctcttcctggtaatgacttagagattcaattattaggaggaaaagtaaaatggtacttggcaaattatggttcttttcattttgattgcctggggggaaatggtttcatgggaatcaatacaaaaaaattatcccaagaatgggttaatatatccaagacctgttttcattgccaggagttatgatcagacccttcgcccatagccttaacttcaacttcaacgtttctgaacccgacacttggcagcattatgtgattagcctaaatggctttctccagggtaagtaagttcgtctgaatagtggaaagctcttttgaaaggtgatgggtgggaatccaaaattcaaaattcacctggcccaggaatcccagtcttactaaccccaactcatcatggtctgtccttactttgcatcccccttagcacctgtagctacaatcagaattgctctagtgtgtgattgtatgttgtcttgaaaacatacaagccaattttccagcaagataagctctttgtggcagagaaattttttttcttgaacacgttacagtacccatttaagccctgaacatatccagatggctcaataatgatcatttatagaagataattcttgggggagatagtggtgggaaaagaagaatgttctccagagctgaaagattcctatcttctaaactttctcaaggtaaaagaagtcatttcttggagatg

SEQ ID NO: 1791 - DNA, 1050 bp, artificial
  synthetic oligo
ttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgg

SEQ ID NO: 1792 - DNA, 1500 bp, artificial
  synthetic oligo
tgacaaaattataaaaatggagaacatgtgagtggttgctaggagttaagaagggggtggagttggagataatgggtgtggctataaaagggcaacatgagggatccttgtggtgatggaaccattctgtatcttgactgtatcaatgccaatatcctggttgtgatactgtatggtgttgcaagacactgtcattgggggaaaccgggaaaatggtacatggtttctctttgcagtatttcttacaacaactgcatgaaaatctgtatctaaggtaacaagcataatttaaaaaaaaaacctcttttctcttatagcatgggatttcagtgtcaaaaatgtggagcacttctcccgtgtgtgtttgtgtgtgtgtgcgtgtgtgtgtctgtgtgtgtacataccactcctatgccaagagtctgcatatccgtgtttttacctgtctctaaagtagaatatctgctggtgtccacatgtgataataattgccttttatattgtgtgccatagatattacggatgtcctatgacgttgttataaaaattctgctgatgactcactctgctttctctaagtcactttgtcattgatattgtgcctggttttataagcttcttggcaatgaagtgatttgtacttgttttgccaagaggtctaataacgttgaatgaaacccccatagcttttatatcttccctgccttcgtcacaatattcatcaacttcatacagcaaagaattacttcgtgcttgctttcaaaatattcaattggtttatcacagggttaactgtactttgattaataattatgtaaaagcggccgtgggccgaggagagctctaggtggccagccaaagacctggggcgtcgtgggcttcggcgagcatgcagggatgagcgggtccctcggccgagcggcgggctcgggtgcgggcggtggtgtttcaggggagcggctggacgcactggtgaaggacaaagtggttgtcttccctcaaggggacggcggagcaaccccagtgcggcttcagcaacgccatggtgcagatcctgtgggtgcacggcgtccgcgactatgcggcctacgaagtgctggacgaccccgagctgcgacaaggcattaaagactattccaactggcccaccatcccgcaagtgtacctcaacggcgagtttgtgcggggctgtgacattcttttgcagatgcaccagaatgggggtctggtggaagaactgaaaaagctggggatccactccgcccttttagatgaaaagaaagaccaagactcaaagtgagggcgcccgggtcctccctgaacagagggagccgttcgtgtcagagactcactgccagaaaaaccttaccgattttggttttcactactgagacaactgcgttgcactgatcatttccgttcgtgagcagtcgggtgattttaggttgtctggtgtttgggctaataagattttattgtgagcttaattacaaccactgc

SEQ ID NO: 1793 - DNA, 1000 bp, artificial
  synthetic oligo
taggtattttcctattttgccctttcagactcaggcaaaaggtattatcactatattgagaagcataggtttgttaaataaagaactctcttgtttctatgaggaaagcaaacttcagtaagagctcttcaaatatttttttcaagacaatgctgagacagagttggggtaaaagatgctattttatctgctgtctgctggtagtaccatatagtctctcatttaaaattcatcaaatgtcagtgtcccatgacagatgaaaaacactgatgaaatacttggaaagcgatggtatctggtgtgtcagattcaaacctagtgagatttttaaagaatttaagaagtattcttagaagtatataatcatttcttggttgaggactgcttaatataatgcagattatattaggaaccaagctacctcctccccaccctatcctcagttttctgttattttcttatttcataagcatggttaaatattatgtttctctagactcgtgttagacaggaagaagagatgtgtcatcatgttttgactaacatgagggatggataacaaagataaattaatctttcaaagcaggctccattttattgagggttcaatctaactataaaccttacttggtgctgttaaacaaaagttcacatttttctatttggagttaacaccttttgttgctctgactactgtctagtctgcgagctaaggagccaggatcaagtcagggaagaagcttagagcccatctaatatctgattggcccagcctctcttgaatacacgagaaataactaaagaatccatagagagctgcattaaaggaaagataactgtatttttttaaatcactgtttgcaaaccgaggatgggaaaataggggaattgttataaccgctgcaaaaaaatggtattgcattttttacctaagtcagtcagttgagagaagccagctgcttctcaactactttcattcttttctgcacttttcataagg

SEQ ID NO: 1794 - DNA, 3850 bp, artificial
  synthetic oligo
atgtatatcagttcgctttacactggcaggagagttcatgttccacttagaccaggaggagaggatatgaaaaggaaaatagcaggtgtggggaggataaaacccatgccttctacagtaactgtaaagtaaaagtgaaaaacgtgagagataaagaggattctttttcctcattgcgggagaaaggggctagggagaggagtctatagcccaggaggttcatccgcagcatgctatggagaaggccaccgtcactgaaatccggtctgtactgtaggacttcataggttctttgctcgccttagagcagaggggaagaagagtcagaaagaattgataacctctgaggtcatcagtcaggggcctaggctgctaagtccagaggcaacaccaagggatcaatgcagctaggtacagttttctccagcctcaactttcaatccccacccccagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatgggggtgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaa

SEQ ID NO: 1795 - DNA, 1950 bp, artificial
  synthetic oligo
attccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaa

SEQ ID NO: 1796 - DNA, 1950 bp, artificial
  synthetic oligo
cttgttggtttaaaacacaattttttattttacagttctgtagttcagaagtcctgaaatcaaggagtcagcagagctgtgttccttctggaggctctagaggggaatctatttccttgctcttcccagttgctagggattacccacatttcttggcttatggcccctttcttcatcttcaaagccagtgacagcatatcatcttcaaatctctctctctctctccctctccctctcctcccctcaccgcctctctacctcccacttcactgcccctcccttttgctctgtcatcatatctctaccttctgactctgatgcttctgcttccttctgttataaggactcttgtgattacatctgtcctactagataatccagataatcatcccacctcaagatctttagctcaatctcatctgcaaagtcctttttgccatgtaaggtaacacgttgataggtttcagggattaggatgtgaacctctttggagagagttatcatttgacctaccacagggagcaatgggaaatactggactatggtattaaacatgctaatacaatcatactctactagggttatgctagtgtcaaacctgatcagatttggggagttcctgacatttctcagatacctctttagaggctggagttggcttctacactaccgacaagatctaatgttctctactggtggggcagtggcagaagctcctgaagggagaaggagcaagggcttgtgcactgaagaaggggattttccccaaagcttcttctcagaaacatacccttctcaaaaagaccaaagtcatgcagaagaattccgtggcagtgggttaaagttacctgtttaatcgaaagtagagataacctatcactttcatttcaaatggaaacctgggctccagaatgtcttaaatgacagtgttaccaacctgggaaaccccccgttgactggtgagcaagaaagtaaggctgaaagcaggcgatctttttatgccacctaatgtatttatgacaggtgctctgctgtgtttggagaaatggacacccgaagttttcggctttcctgcagagaatatgtgatcccttctttctttctctaaggatatttaactgtatttcatgatatgacaataataactcttgactttgatatagtttctgctaggtctggggtcctcagaactgactacatcaccagaaataaaactgaagactagataggggttattgagatcccattaaatactgccttggataagaacagtaatttcagcttaagtgcttgattatgctgaagattctattgcagagtatgagtaacttagactgagaaataattcctcatgtggttttggatctgcttgggaaaatacataccagaggtttccaggcatctctttcttaccaaatctcaatagcattttcttcactcccatgtttttctcatccccactgacactgactaccctaactttttatatttttttaatattttggcttcagtggtccagccttatactagttttccttctattcttttgaccacatctctgctttatttcctggctcttcttttttcttctttgttataactggattctcctaaagacattctcatggacactctcctctttatctttatatactctttcgtcaatccatccattaaacatttaaaaagtatttaaatatttatgtttggagacctgtattgtgctctggggatagataaacgtattagacacaatccttgccttctgggagctcaaaaactggggaaggagacagaaaatcaatgaaaatagtatagtgtaatatttagtatgaaatatataggacatgttttatggaactccatggtaggggcatctatatatttccagttgggttgctttcatctagaaataacagaaaattcaaaatgatttaagcaatgaggata

SEQ ID NO: 1797 - DNA, 2250 bp, artificial
  synthetic oligo
tatgcaaaaatatttgtggggtttttttctgctatgtatagctgacattgttctcaggactggactctactagttttattatgaaaatgttaacatttcttcatagagttgttttatagaaacacctgtttttcagaaacattctggggaacaacctgaaaacttttaaataatatttagagcatggatttattttaggaattacctgatccctttttaaatgcatatttcgactttctttaatcatgaaaagttttcaacattattttgtcatacctgaaagcttttaattactcttaaaaaccccaactttgccatagtaaattatttaatgcatcacaaaatagtgttatgaacttgaactaaaatggcaaaattgggattctgtttctccagttatgtactttgagggtcttactatgccttatgaaaattcatttttccccacgttgcagatatgaagagcaaggagcgggggtgagcaagcaagcagatgctgggtaatcatggagcagaagttaaaggtgtggatcgccttttcattaattttgttttttaagcctttccctcttagactcttccctttcttggtaacactggagtatctactgctccagatcagaagacttcggactaggaagatgaactgggctatttcagccaaaaaatataatagagcagacatttgccatgttctcctcaaacacgttaagagtagcaattgattctcacagtacattgttacctggcttgttaattataatcatagaacaagagtctaaaattcaaggaagctgtctgcgacacttactcgtcacaaacgcgatcaattaaacgctaatctaacagtacctattagagtgcactgggatgtttcgtttccttttggtctttaaaaccaaatggctactaatttcctttctgtagcactgagaacttctctttgtatttctttgggccacctcaaaaacacctccaggttggtatcccaggaaaacaacggttaagttcaggacgtttactgaccaattgcttcatattggagatgtagagcttttctacccctattagcatatcgccagtagcagtgatgcagatctgctcaacccgaagctgccgacggcgagtacgagctgcaaaccagcccccgcccccgcccctactctcccagtggcgacacagacgtggaaacatctactagtggagtgagatcctctgtctccgcaattgtaaacaactgactgcatcgggttcactgaaatgtttaaatacactcctgactgcaaacacatccactcaccaagtagcgctaacaatctccccttctccgcctctaggcaaagcatcctgaaactaaattggcaatcctcctgttatggagtggaagaaagtgaggttacatttccccaagcctgcctagcgggtgcttggcgctcgcagatatgctggccgttgctgaatctcggggaccaagtctctggatgaaatgcggaaacacacaaacccgcacattggagcgcatggttaaagtcaacaccgacggctcctggagcaccgcctgggttgtaatgactatctcttttgacaaagattgacaaaggtatagggaggacgcatcgggtggggccctcgacggcggcgtaggttaggaggtcctgcagttcccccgggaacccgggctccctgagtgaggctcaaatagaaattcagaagcaaacaggtactaaagtgcgtcctagcccttgggcatattctctgcggagacagcaggacctggaccccagtggcagagccccaggcgaacgctccagggtgggagggatgccagagaagcgcccctttctttctttttagaccgagcctcccatcctcaccccaagcacccaggtccacttgttagagtgactgggctctgcgcgagagccgaggcgaggaggctccctctcagaactgaaggagttggttggtaaaagtgccgcctgggaagcccagcgagccctcgaagggcagcgtccccagggcccgctggaagcttgaactgcgaacaaggccgacctcccttctgccccagatggtccagagccccatggccggcggagaccgggagaagaaggatgcggaggctctgccacctcgggcaggagtcccagagcggactcaaccggccgctaacagccaggagccgccatccgccgcctgcagcctcggggcgaagttcgcctgtagtccttggggtagaaggttgggggt

SEQ ID NO: 1798 - DNA, 2350 bp, artificial
  synthetic oligo
agaacgggaatcatccaaactacagccaggagcacgccactgggggaagcaggcaggtgagaagagctgggcccactggtggctacagcaggtgcgaggtgagagctgaatggacgtgaggcctccagagaagcagaccaatctatggaggagacataaccgccgggggtgggcacttgggggccccttcagtcctaaggagacaaaaatgacaagagagaagtcatggacatatcctaggccaaaggaactccccaggaaaggagaggagagaggagaccgccttctctttcccccaaactccactcagcccaaacctcaatcccaaggcccctgagttggtgcctgcctgtccccactgcagtgggacagccagcagaccagggaaggggcaggcttcagctctcctctctctgctgccaccttggttcttccctccttctcacagctccgggcaaccacagccacaactgtcctcttgttctctgcctgagagcccctagagctctctgcctccttccccaactctggcgacaatctacactggacatctgtaggtttgccctgggcacccctccccagccattaaggtccaccaggatgtctagaaatctctaagcaggccagcctccccaaccccaggcagcagggtggaagggagactggccccaagtatcaagcccctctctaggcctcagacgaggagatcgtctgtaaaataaaggggctagacagctgccccataagctctcttgccagctctaagcctctgtgagtgtggcgccaggactgtttgatggatgtgtctggccagtgatgagcggcaggatcacccggcttctaggctgtccttctccctccgctttagcactgtccactgaacagaggctcaagtacctgcttcagaaaggcatgggtcccttatgggagaggcggggccgctggcggcggaatttcctccgacctccctgccagggccctggcccattccttgaccctctgggctgcaccaggtggcggacattgccgtcttccagcccattcccatcgggaagcggcatcagggaccctgcaggaaggagaaagcctgttagtgaggaaggttgttggaaacgggcaggggctgcagaccacaggcccgcgggaggggtggtctgtccatgtggtggcacttctcatagattttctttgtttctttttttcatattgagggaaaatttgccatttctgcactgtcctgggacaaacggaacctactactcacatcttgccattgatgtagctgactttctgtccttttgacagttatatcatgtttctgacaggcacaagtgggttctttctttggaacgtcattggggggtgtgcactttgggttgtcacgcctgtacttggctggggggcaggaggcagtaatcaccacggcacccctgcaactggtacacttcaaacatttcagacatatgacattacaatgaccctcccaccgccatggacccatcacccagattcaacagttatccagatggagtcacatatgctttagttatcccttttctattttccttgactgcagtattttaaagcaaatcccgaacatcacgtcattgtactcctacatcctttgatatgcaggatgacccacttgtgagtactagggagctcatatctcgcccctgggtgtctcatcggtggttaggcatctctagggcgccaagtcctcccagtggatggggctgggccaggcgggttaagggggagaggtctctgactcagcctgcctcatgctgtgaccagatttagagacctgagaccagatttagagaccaataaatattgcatgaatatttgagaatgaataaatgaaacaatggtcaccttcagcagcatgtctgtgcaccaggaggggggtgggctgttgcagttggtacctccccaccaatgccctacctcctgaaattcccagatcacaccctgcatcctgtgtctcatgtaaattccttccatttcaatcccagctggcttctattctgcactctggggctcctctttacatctgtccacatctgtcaggaggcttagagtagaggcctcctgacaccagactgagccctgacaatggaatccaagtggtgcagggtatccttgggtgcagtgagggaaaaggcatgcaggccgactctcgtgaagcctgcagtccatgcagggaagctgagctgccacccccaagacaagcctggctggtggtggcaggcagtgtgtggagatgagatggtgctggggaagaggcagccaggcagggtacttgtgcaatgtccagtacaggcctgtgcagatacagcatctgagg

SEQ ID NO: 1799 - DNA, 4100 bp, artificial
  synthetic oligo
caaggtgacgggcaggtgatgccaaaggccgagttgagccccgcaaaagaagcagtccttgtggccagccgccccatggctcggggcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatcccccaggaggcaccctctacctggaatgcccccaccccacccttccgtgagcaattcattctttgcagcagcacctcaaatcccatcgcatccagaagccttctcaggataacactaatccagcaggggccgcccatcagctcctccccactgttgggacatgggacagctcctatggtctaccctttcttgttccctggagctgtcctcattctagttccccatcaacgtaagaggcaggtggtttacccaactccacacagtcaaggctggattcattttgcgtgtacttgcgattccgctttagaagcgggtcctgaagttgtttgcctttccagactcgattgttagctgcttctatagcttgggagctcccaaggcatggggctgcttccctcattggactgggaaccccctaaggtaggatactgtcttctcactcttctggatctctccaaagtccccaatatcttgctctgcacataggtggcactcaacacatattaaaagactgaatcgaaaggtgtctccacctttcagcaagccaggcagtttgcttgaagtgttaagtccagatttacacaaaagatacattggacagggtgcgtgtgtgccataaaagacatgagagaccatggcatatttaaaatatctttgaaatgttgcaaaaatcctatatatacacaatgtatttattatcagtctctctccaccagaagggttacctccacaagggagggatctttgctttgttcacagctgtgtccccagacctagaacagtacctgcgacatgactggtactcaatacataattttgaatatataaatgaaattttcaaaaacatctttactgcctaaattcaggtagcaggaagggaataagataaggttctcattaatagcctatggcccattaaccacactcaagtaaaaaaaaaaagcatgtgaagcatggcacccctcttcatccttgagacccaggatatgagtagcagacatgggtagcaggagaccattctcccttcactgttcccctggaaagagtttgctttctttctcttttctttttctttttttcttttttctttctttcttcttttttttttttttttttttgagaccgagttttgctctgtcgctcaagctggagtgcaataccctatctcagctcactgcaacctccgcctcccaggttcaagcgattctcctgcctcagcctcctgagtagctgggattacaggcatgcgccaccatgcccgactaattttgtatttttagtagagacggggtttcaccaggttggtcaggctggtctcgaactcctgacctcagatgatccacccgcctcggcctcccaaagtgttgggattacaggcgttagccaccacgcctggatggaaagcattttctaaccaggaggagaaacacctggcttctagtctccaccctcatttgctgtagggccttgccatcatcacctaaacttactggggttcatggaggtgataatctctgctctacccacttcaaagttgttatgggattaagtgagataatgtgcctgaaggtaccgtgcaaattaagaataagctcttgcagggttgtttttaggaaacttggtgctccaatccttgattgggcaagcccatgcacacccaaataagtgtcccccataactaggttaatagaagccttcatatttaattgcacctttactagggtgtgtatggcatattgctaagtggttggaacacatagcgctttctaatacaatagccactaatcatatttccaatgaagtttaaaattcagttcctcagttccactggccacgcttcaattgcctatatgtggctagtggctactgtattggacagcacagaatagaatcttcaatcactgcagaaagttctattggttagagcattcattcattcttcttttttctataatccattttcccaccctacctagccttcaaaatgtacaaggtgaggggaaaaaaagcataaaagcaaaccaatagaaattcaagccaagctgaaggcatgcgtttagagtaagatttaaagatctgacacttgggagaatcattttttaattgaatccttctcttcatttaaccaaattacatccatttttttttagaggcagggtcttgctctgttaccctaggctgaagtgcagtagtgcaatcacagcccaatgcaggctcaaacttctaggctcaagtgatcctcccacctcagcctcccaagtagctgggactacagacatgcaccaccataccaggctaatttttaaatttatttatattttttgtagagactgagtcttactatgtttctcaggctggtcttaaactcctggtctcaagcaatcctcccatctcggcctcccaaagtgctgggattacaagtgtgagtcaccatgcctggccacatctgttttcgtagtcccagatccaagatttcatctttctttctcaggacacccttgcccacagtgactttgccctctccataacagctatggctgtacctgtcattggtaggtcctctcacagtgcatcaggaacacttttgcatctgcacactgtgctctacgggcctgctgtaattctgcagagaggacccatcaccaccatatccattcaggggtcaaggcccatgaggcaaggaacgcagctctgattgcccactctgaaccccttgtaggctcccagatatcttaatatcagattgaaatgaccagttttcgaatatctgtatctatttgccagactttaaggtcactgctgtgatagcacctagcacaatgcctggcacataattgatacttcataactgcctgtcaggt

SEQ ID NO: 1800 - DNA, 1650 bp, artificial
  synthetic oligo
tgcccttgcctccccggccaaaggcagccgccgtccacacccagctgcctgagggacaaggagggtgtttacccaatggcctgtgtccttaaaggactctgctctcagttacacagcaaacagctggcctcgaaggggcctcgtcctggccgccgcgagcgggcggcttctgcagcgtttaagcttctatctaccatgaagatgcttcccccaccctcatgcctcctcccgggggtgggcatgaggggcacttacgagctgagacctcacaggcgacattttttaagctgctcattctgacggaacagtccccaagacaaacacaaggctttctgtctcccagggcttgtgcgacttggtttcagactctgccacccactgccgcagacagcggccgtcttcccaggaagaagacatttcctggcggggtaccgggactgacgggcggcggcgcagggcagtgccagccgggcccaggaagtgaacgcgctgggcccgcgaaggagcgcgtcgcccgccctgaggggggcagtgcagcgcccaccgcgcgccttcgccagtcccctggcaccgttgccctggccaggggccgggagagggcgtggcagcgcggcagtgcgcctacgcaccgggggcactggggatcccgcccccacgctggttcccgcgctttcaagagcctcagagccccgagacaagggggtgtcggctctacccacctggcccagcccgaaagaacagggccaacattttgaaaccaaaccaataatagaattggaatacttttgatcactttttattttccttttctggaggagagttgtggggcgggggtggggagctggtagagagaatctcagggcgctgtggctttgagggcgggttccctgcgcaagcagcagtgctcacagtgcgagcaatcatggctaggcccagcccgcggttagttgggtgcagggacgtgacaggaccgcgagggctgattctttagtctattgttcccactcctcagaaaggactcctagcaaatatatactgctagtcccagctttcccgatggaatggaaccccttgctttgctttgctgtcgctattcaggatggggattttgtccatgcagaaagacatttacattatctacactggaatgccggcccactagcctggcaaaatgctgagccagctattagatctggactcgtggaggagtggagatttgcctccattcaagcaaccacatacttccctggaagctgggaggagcaccactaagtccaccctctcctgcctggctccttggtagtgcttctcaaacattatcacttggacaaatcacctgaggtccttgttaaaagtctgatttagaaaatctggggaatccggtggcacccgagactgcatttttaacaagctcccaggtgatgcagctactgctgtgcaccacaccttgagaagcaaggggtacaacattgctctcaactgcggctgcacattaaaattaacttggggagctttaagaactaattaggccaggacccccacccccaagatattctgatttagttggtctaggtagagtcaggccttttttttttttttttgacggggtctctctctgtcgcccctgctggagtggcgggatcatggttc

SEQ ID NO: 1801 - DNA, 1500 bp, artificial
  synthetic oligo
gggacagtgtttgtcttattcacctcccttagcccagtcgctggcacaaaggaagcacttaataaatggtagctattatcattattttatttctgaatcctcatcattctgatcacctccccaaacactccctagtttgaagcgtcctttctgtaaagtggtactcctaccttggcccggtgctccaggggtggtatgaacaacaaaatgtagaagctgacagtgctgtccccacctactggggacataccacttctattcatgctgcttaaggctaccttcctttatcaccaacttcatcatactctcagctgcaacagagctggaggtcactcacacctacacacccacctgctgcaatcaggacgtctgccaagccagcttcccgccatcccgtttctgtatggttgctttttgtaacctcagtttcagctttactctcgttcctatggggtcccatcattttcttgggccattgttgtaacctgtcccaatctttccatgtccctattcagccagccattctattaaccaaccctcctggcctcgtgtcatctacaaaactgagcagtgcgcgtccctgtgcctgcttccgaatcctggccaacaatatggcgcaggacaaaggccaggagcaaggctcttgaaagtgctactggagagctcctgaggcccggtatccatctcagggggcagcagaggggggtgtttaatcagcaattcaaactgtgcctaggccaagttcttacgaggctgtgaaattgggaatgatattagtttcctagggttgccataagaaaataccaccaactgggtggcttaaaacaacagaaatatatttgcacgtatccctgtgtaacaaacctacacattctgcacttgtatcccggaacttaaagtaaaataaagaaaaacaaaataaaagaaagaaaaaaagaaaagaaatgtatttgctctgttattagaggctacaagtccaaaatcaaggtatcagcaggaaaatgctccctccaaaggctctcagagagaatccttccttgccccttccagctcctggtgactcctggtgttctttggctcgtgcagcatcactccaatctctgtcacgtggccttcctttctgtgcctgtctctctccgtcttcttataacgacacggatcattgaattgagggcccaccctactccagggtgaccttatcttacttaactaattacatctgcaaagatcttatgtcccaataagatcacaatgtgaattttggggtggacatgaatttgggggaaaacgctattcaacccactacaaatagccattctttctcacaggagcttcatgagggaccagaggataaggtagcacagggcagggcttctcaaactataagagccaagaagcacctggggatcgcattaaaatgcagatttggagccagccagcctggggtgggtctgcatttctcacaagctcccaggtgacatccttgctgcttgtcctgct

SEQ ID NO: 1802 - DNA, 2100 bp, artificial
  synthetic oligo
caggatttcaacatatgaattttggagagacacaaacattcagaccacgacaacttccccgagctcccgttctaccctcatgcccagcagagttacttcattcgtcctctgtgctcctgtcagtggacctgcatcagtgtccttactgtgctggactgagatggtctctggaaacccctggaggacagggaccaagacatatctttgtacctagtgctggcaaaaggcctggtccagagcagtggctccttcagtaaatgtttgtcaaatcacactgaaccaaatcaaactgaataggatcttcagctccatcagatttcaatttcatttgctttatggtcacctttgggaaaaagggagcttagaagcatttgctgactgtgacagagaggatgccgagagaggggctcggaggtgtttgatcaaatggaacattacagaagagtctataaatggagatcagggctctgctaccacccctacctcacgctccagttgacaacccaaactccagaggggcccatttaataagccaggaccaggcatcattggtgtggcaactgcaaagtttcactgggctggggatgcccatcatgctgcacatagctgtcctccctccccccagagttgtgcaaagcagcagacttgtaccacagatgagcagaggggtgaggctgatcagcccatggtgggatggcccttggcctccaccgtgtatctctcttgtacccagccccactatgggcagagggagaaggcagagaaaaataataaagagtaaatggcagagtctacacacttacatccctacttcatccttagtgaccttgtaaattggcacacagggtccaggggagagcatgtgtcacagctcagttccagctcagctatttccacccctggagcacagaaagctggggcaacatcctggggcacagagggcaacacagtctccatgttttggtcctacttttctgtgctgccttggaaatgaatcatatgtgactcttcccaaccagagaagttgtgaacaccacaggtctgccatctgtattcatccaggggcttgttggggtcagtgcagctgggataaggagaaggagcagaggagaaagccccagtggaggcctggcggcaaagaccgccccttaccatgagacaccataacactgtggccagagccggaggccagtgcaagagtgggaagaggggtccagactagaccctgctgcacactgttaatactccatccttccatgcagaaaggcccagggctgatgagttaaagcccgcaatgaggatggcaagcaggtgagtgacggagtggacacctggacaaacttctaagcaagtgtctttgcaagaaccttagcttttttctgggtacaatgttccatgtccactgccacctcagagtttaggccccagaggaggcccatgcataggattcaggctcaatctgaaacaggtctgggctcagcctcagtctgtggctggcagcccagtccagctcactgggcccgacgtggcctgcgtccatgtgcttggcttcattaacaccaagctctgaccaaccccagtgaccaacccctggcccagtctctaggaacagcttcagttaaaactttgtaagatgccagtaaatagcacagtaatgaaatccacagatgagctaaaactggactgttcagaatcagccaaggatgagatggagtctccagggggcccggcaggctagaaatatggtgaggaaataaccatgtgaaactcagcctgggaaggggccagcaaacgtcatgtgcatgctgccaaattctccccacagttagcaggaagcgggagggctgcggggagcagctgagctaagggagccagagaggcgggatgtggtaggggctcggagcgggtggccccagtccagtcatttgggagtgagtctgtagagacagtacagggaccaaagagcaggcccctgcccatgtgggcccagagaaactccaaggcaggccagcaggaccaaggagttccagggggtgcagagctttaggcgggacgggaagggtattatggatgagtcatgcatgggacagctttgtgtca

SEQ ID NO: 1803 - DNA, 2700 bp, artificial
  synthetic oligo
ttcctccaagaaccccagaagcctctggcctttcccggcataactagaaagagaagcagacagccccaggatcttactcaatgagagcttaaaggcttgccttcctgtttcctctctcatgaaggggcagcctgagatgccacgaagagccctgggctggaagttaggaggccggagtgctagtcccattcccgcctgccagagccatcctctccctgggctacagtgttctccatctgcagaaatgatgaggcaggatgcgtcaagtggggaaggcagttggttctaccagaatcatggttttcaaacttttgcagtttggaacactttctttaaacaaaatctaacagggcaactcaacgtgtaaggtggcagatgaaaatagagctgctctcaacccattcccctccccagaggttcccctagaacctccatggtagcccagagccccttttaaagaccactgggttagagctgtgggcttccaacttgagtgtgcaccagcatcacctggagggtttgtaagaatagattgctgggcccacccctaaagtttctgactgtgtatatgggatggaactgagaatttgcatttctaacaagcacccaggtgatgctgatgttgctggtccagggaccacaatttgagaactactaggttacattctacccaagggccttcctgtgattcatgtccagtcattcaatatttacattaatccacttcagatagattttctgtgatattaaagcataggagaacacctggtattgtccctggcacatagcaggcactcggtcaaagctggtagggtccgttctaaatgctctgcctagaagtctgtttaggtgtacaatcatgttagccactggtcaagggattcacagaagcagaagctttacttttaataagtttacagtctgccatggcccctccacccaccaggaaataacacccccactaattccatcattagaagttactccatgttaaacattatcctttccagatattctctttttttccaggtaaaccccctgggaaggggtagttgttcagtccctgacccctcagcatttcttagatgttttccccatgtgaaggggacatagcttcgatcctctaggagttcttccagggcaaggaccttacctgtatcattctcccccacataccccacggctcctagcccagtgtctggtacagagtggacactcagtacaagtttgcagaatagaataaaggaagcatgggacccccaacttgacccagcccacgtgagccaccagcacccccatcatggccaaggctgctaactggggaactttggagggtacatggggagggcaggtctccagccacacgcacctgggattgctgcccgggaggttttgcaaactggctccaggaatgttcggggcctcccattccccacatcctccttttcagcctcaccacgttcttaaacaaattggcactgaccctggtgacagacttgatcatttccctttgcttcgtgattgtgttaagtgactgccaaaggcctgttcctgaatagtcagcacattcctcaggacggtgagtgggagcccatctgctcctggagcgcttcctttcctttattgtgctattttggcctcaatttcccatttggacaggagcatcttccagccggtggggaaagggagagggtggagaggggcgccacagccttccttcatttctcactcatatccctggtttctctggaaataaatcaacaaatattatactacgtgcctggcgctgctcttagctctccacatgtgtccatggagctaatccttacaacacccactatgaggaaggcacaaatattacccccattttccagatgagggaacagagactgagagaggccaagtgacttgcccaaggtcgcacaatatgtgatagagctgggatttgaacctagacaggtctggctctggagactgagttctcacccattggctctaccaagggtgtggattcttgaggctgtggatctgggcccaatggtatctgaggccatggccctttccctcttcactgtgtgtcagcaggttctaaagtcacttagattgaacacagaattccagcccggcgcggtggctcacatctataatcccagcactttgggaagttgaagtgggaggatcacttgagaccaggagttcaagaccagcctgagcaacatagcaagaccccattattacaaaaaaaattttaaaccggccaggtgtggtggcgtgtgcctgtagtctcatctactcggcaggctgaggtgagaggatggcttgagcccaacactccaggctggacaacagagcaagaccctgtctcttaaaaatttttgaaagaaaacagaattccttgcagatcagaaaaggttatcttcataccttgccactgacccactcgtttaatgcaacatttgaactcacagatgctacaccaatgtggactctacctttgggttataaagggctgatatagtaatgctaaacagctcattgtgtgctcttctccatgtaccttgcctcatttatgtctcacatcaactctaaagtaggttgtagggagaagctgaggctcaaagatcccccagccaaccacagacccagcatgtgggcaattcattactacactagatgttaaacagccaggtagcttttgct

SEQ ID NO: 1804 - DNA, 1950 bp, artificial
  synthetic oligo
ctcactgcaacctcaacctcccaggttcaagccatcgtcccacctcagcttcctgagtaactgggactacagatgcatgccaccatgcccagctaattttttaaaaattttttgtagagatgggggtcttgctatgttgcccaagctggtattgaactcctgggctcaagcaatccaccctcctcagcctcccaaagtgctagaattataggcgggagccaccttacccagcccaatgcattattttgataaagatttttaaatgttaattttttgagacagggtcttgctgtgttccccaggctggagtgcagtgactattcacaggctcaatcatggcgcactacagcctttaattcctgggctcgagatcctcccaccccagcctctggagtacctgggactacagatgagcaccaccacatccagtttagatgttaattttttaaaggagttttttgggaggccgaggcaggcggatcacctgaggtcgggagttcgagaccagcctgaccaacatggagaaaccccatctctactgaaaatacaaaaatagctgggcaagagcaaaattccgtctccaaaaaaaaaaaaaaaaaaaaaaatgtggggggaatttacaatttccagaacaaaacataggtttgtgaggttttatattagtggttccccatgagggtgattttgcccccttccgaagggatatttgccaatgtctaaagacatttttgggagagtgttactggcatcaaagatgctgctaagcatcttataatgcacaggacagcttgccgcaacaaggagttattcaaaccagaatgccaataggggcaaggctaaggaaccctgctttaaataaatgtgtggatcatagatgcataacaagttattacggagcgttatgactgtttagtaaatagagtcaacctgtgagaagaacatgatgtaggaaacccaccatactatcccacaatccattttttttttttttttttgagacagagtcttactctgtcacccaggctggagtgcaatggcaagatctcggctcactgctacctccacctcccgggttcaagtgattctcctgcctcagcctcccgagtagctggaattacaggcacatgccaccatgcctggctaatttttgtatttttagtagagacagggtttcaccatgttggccaggctggtctcgaactcctggcctcaagtgatccacccacctcgacctcccaaagtgctgggattataggcgtgagccaccgcgcccagacccacaatccattctttagtgcctcagagaaaaattctagaccaagtgatagttccaacagcagtgctaggaatataggaagcatagtaaatacagagttctttactgacttctgtccacaggtcctatataagccttcattatctacaaatgcaaatcccatattacctcactctcccttcactgcctcctcctgtcaatctaatgcctccccttgctcttcacgagtcaacactcaacactaccgtctttcttttatcccaaaccccaattccaacatttctcccagaccacaactcatgctgtaataccttctctgcatctcctttctgtcatttacacagcacctctttgatgaaatcctctccaacttcttggaaaagagtgaataatttctccctgattccatcttgcataaaaccacaaccccctccttgctcaacaacctaccaaaagcacctacttttttacacatatgcactaaataaatattaaacttctggatgtgttaggtgtttgggttcttgtacactcatgataaaggtgtctgtgttcatgttatgtccagctagaagtagtttagacaaatgtctgctgatccggtctgggaatatggtttctaaggaggagtttgagaaggaacaagagtggtcactgttccatgctactactcg

SEQ ID NO: 1805 - DNA, 1850 bp, artificial
  synthetic oligo
gagtagctgggactacaggcgtccaccaccacgcccagctaattttttgtattttttagtagagacagggtttcaccgcgttagccaggatggtctcgatctcctgaccttgtgatccacctgcctcggcctcccaaagtgctgggattacaggcgtgagccaccgcgcccggcgattttttttttttttttaatgagatcatttcatgtgtttagggagcctgcctgctgtgatcttcctttctgatggttctgaggccacaccactggttcttctattttctgctgcgagcagcctgcttcctggctcccctctcacgacagacacgtctgcaaagaactcagggtggggtttacaaagagctggaagggagcagtgcctgcagtttaaattcggagcctccaaataaaagcttcaaggctcccaatagtgttggaaagacagaggaggtctccagcagagagggccctcctggcagttccggcaatttgggcggcatacgcaattatgaagccaaagaaaagccaaatggccaacctcactcagcctcaaacacctcacacactcccacccgtgttcctgctagtggcaggtatttttagagtcctgagctcatggtgttaaagcatctgccacatgcctgagggctggtagggattcagacttcttcagaggcaaaaggcaagagtgaagactcctggggggtggggggagtggggatcaggagccaagtggtaatgatattcctgggctatgcctgctgtcttcctactgacctccattcctcctgtggtctgctctccctttcttcctgttcggaacaccacggagaggtggaagaaatgaaaatattttctgtctcttgcttgcagaagcaaatcagtctttgaggacttatgttttttctgtgtgatcacagtcagacgttctctctgaaatccccttggcacatatctaggatgccagactgcttgtagttttagtggttcaggccatcactgccttttgataatgtgtctgctgctgataatgatgatgatgacaacctcagtgacgagtgtggtctgatgcagaaaaagactgcttacagtcttgctggagagatgccaagagcactgacgagacaattagaaaacataaatctattcaaaatggtatgatgcagactcaaagtgcaacagagattcctaagaaaagagaattgaagggaagttggcgaaggtttgaggaagaagcctgaggcgtgagcttaaccttgaagaatgggtgagatttggatagggcaatgagggggcagctgattctataggggaggagtggactagcatgacccaaagtacagaggagggaatcaaccaggtgtagctgagtagtttgaaaccaggttgggaagggtcaaattatggcagacagaattccacatgtggaatccatgtgatgccacatacagtagagggctgcagtcgtttcctgaagaggtgaatggcatgctgatacaagcagggattgactaaagctagtcagaaagccagtattcagagatcgggcactggggctcacgcctgtaatcccagcactttcaggggctgaggcaggtggatcggcagtgattgggcctcccaacatgctgggattacaggagtgagccactatactcagactccaatttatttttatttatttattttttattttgagatggagtttagctctgttgcccaggctggagtgctgtggcaccatctcggctcactgcaagctccgtcttccgggctcatgccattctctggcctcagcctcccgagtagctgggactacaggcacctgccaccacacccagctaattttt

SEQ ID NO: 1806 - DNA, 1150 bp, artificial
  synthetic oligo
gggtgaattttatgatgtgtagtttgtacatcaatgaagctggaaaaacaaataataaggatataatatgaataaatgcaacagtaaaacgatgtagttgtcttagccccctctaactgccaaggaaacagaggactagttattatagggttagcatatgaatctagtcctattgtgccaagattagtcatcagctgaggcaataataagagacatagaggtatatgccaggaaatagatatccttcctacaagtggaggttattcctctttcagaatggtcctcacccagtggcgcagagattaccctgagtggtgattccacacacatactgctagctgtacaagccagttagcctctggcagacgctttggcttgatcagcgttcttagtttcaagcaacaaataccaattctgagtgattgaggtgggaaagaaattggacagctcacagaatcttgtgaaggttgagaacaaaactcaaagctctgtagccaggaatgttgcccaaaaccatgctgtagattcagtccagtgagaagactgctttaactaatgctactgagtgtcctggactctgccccttcctctccaccactactgctctgggagatcaatttgcccacgactgtggctgttgcaagacagagaactcactactatcctagcttttatgtgactagctccttactcaaattcctatgcaggttttttgattggtggggtgtaggccacacaactacatccaggctgtgtgggaggctggtaaagtgagtatttgataccttctatcagcttccatagtgtgaaccaggctgaacttttcctcaagactcatatgttggttaattccctagacgcagagagtgagttccgatattggaccgtaaatacacacacacacacatatacacacacacacccctttccactgcagccttgctcaaactgtagtagtccacagaccagcaggtttggcaccaatgggaagcttgtcagaaatgcagaaactctggtcctgctctagattttcaaaatcagaatatgctttttaacatgcacctcagataatttgcatgtacacaaaagtttagaagtgctgctctactttatacaatatgtagtcctttttaattttcaaagatcagtc

SEQ ID NO: 1807 - DNA, 1450 bp, artificial
  synthetic oligo
tgtttctttttacctttataaaacggttactggaacatgtaaaattatgcgtgtggctcacattatatttctgttggacagtgctgctctggtatactcaaaaatagaatttgatctataagcatctttttagcagtacatttcttgctttaagtaagtgtacctgtacaccagagacaggctcatttcaaaagaaggacagggaggagtggcgatttgaaaatggggaaactgattatagaagaaagtcaggactctgcctcagttacctgtcagtctgggggtgggggatgctgggacaggggtcaattgcctgaagcaagtgctctcatccccctagctcctgctgatctagttggggctccagagtggggaggagaaaggcactttgaaacttctctgcccttaccgtcttagccatcaaactctgagctggagatagtgacgatgtgacaggaactttccctgggcctctctgggccacaattcctggccgagagaaagaggaggaatgaggtgagcaccttcttcactcctagggccatgtggtagagctgcagtcgcacctccttctgccaataggcatagatgagtgggttgagcagggagttgcccacgccgagcagccacaggtaccgttccagcactaggtagaggtgacactcctggcaggccacctgcacaatgccagtgataaggaagggggtccaggatagagcaaagctcccaatgagaacagacacagtacggagagctttgaagtcgctgggagtccgtggggatcgataacctccagccatggctcctgcatgttccatctttcgaatctgctggctgtgcatggaggcaatcttgagcatgtcgcagtagaagaagacaaagaggagcatggctgggaagaagccaacgcaggagagggtcagcacgaagtgagggtgaaatacagcaaagaagctgcactgccctttgtaggcagtctgctggaacatggggattccgagtgggaggaagccaatgaggtaagacactaaccacagcccggcaatgcaggccccggccacgaacccactcatgatcttcaagtagcggaagggctgcttgatggcaaggtacctgtcaaaggtgatcagcatgaccgtgaggacagaggcagctgcggaggaagtgacaaatgccatccgcaggctgcacagggtcttctgtgtgggccgagaagggctggagagctggtctgtgagtaggccagagatggccacaccaatcaaggtgtcagccacagccagattcaaggtgaagcagagactgacaccatcattcttgtggatcaacagcagcacagccacagccactagtgtgttagtagcaatgatgagggaggccaggacagcaaggatcactccaaatgagaaagatgattccatgtctcgaagtggcaggacttcacttacca

SEQ ID NO: 1808 - DNA, 1150 bp, artificial
  synthetic oligo
aagggtggagttagaggccagatttcaaagatttaaaggaatgagtgtggtagtggagggaaggaaagcaagcttcagcaacttgagaacccagaggcctgaaggaaaagcttgtggagtctagagcatcactgaagtcagagaggaaggggcctgcagagggaggcactagaaatgagggagggactggccaattcatataaagagatgacagaggaggaggctgagaggggaattagtggaagggtttttcttagaaaggaggattttttttttttcagagataggactgaaggaagagagactaaaggaaatgtattaaggaagagaatgagccacgagaaaaggaaagagtagcaaaatcttatttgggtctacatatagagccttgctgtcttggcagaatgctcaatgctcagaacacccttctgaaagcttgcccgccatccgggcttcctccacaagattcaaggtctcattgattctcttcagcttcagtcagagacaatctgacagctgcagttggctcagcccttcttgcagcaagctgacaccatttctggtgggcttcaaaggcagtataaatggttctcccttaagagcaggttacactcggcacctaggcagcctcattacacaactaattaaacctctatcacttgaaaggaatcaatggcagttcaagatctgcttgagtagactttgcatttccgtgttcacacatagcagtcctacagtcaaggagttcccaaccactgcaaggggaagatgtaaacaagaccttagaaatagattgtttcatttcctataagggggtgtcccagaagatcttactcattagacagtaggcaagacccctttaaccttttgaaatagaagggagtttcgggcagctctttaaacggtgggaagctcaagctttctgctctggtgcatccatctggacaaaggcatgtcaacttctcagagtctgtccttcctggcagttccaaagggaggtccccgggtgttgagtgcagtaagctagagcctgggttttcccctacagaaaggctccagccctgttgtaaatacaactttcagaaactaatttaactggttccacttaaatgaactgggaaatgacccaatagaaggggacagagggact

SEQ ID NO: 1809 - DNA, 1600 bp, artificial
  synthetic oligo
tgtataatgtggctaagaacacctacttcacagtgctgttgtgaaaattaaattaaaatatgtattaagcacttagcacagaataggcagaaaacaaacattagctccctcctcttctctcatctataaaaatgagaataagaaaaaattatcctcacagggttatgatgaggatgaagacaggcaaatatacaggaaatgcttgtaaactgtaaaatcccccataatagtctttacagaacatttgaaatgtaccaggcattgtgcaattaacaaacgttaatcaattaggtaaacattacttaagtgtctactatatggaggacactattttaggtattgtgagccatccagagagataagggccatcagagtagatgagcccctccacataagaatagagcgttgaggacaggacctgagcaatgctcccatttagggtaccaaacgagaatgcagagccagaaggagaaatcagaggtaagaacaccagtatagcagtgtccgcagagccaagggaagagtgagtttcaataaatagagacttacaatgtagcattctgcagagaatgaaaatcaaaataggacagagatgtgtccccttggagcaggcctccaaaaaaaacattcgtaactgctttgagaggggctgtgtgtgtctgcacgtgcatgcacgcacgtgcatgtatggagggggtaggagccatcttgccgtggatggcaggtatgtttggggaaacgtaaggtgagcatatctagaatactctttcaaggtgttaaggactaaggctgagaaaggaagcatggatgatagctagaaggggacgccgggttgagggaagactgtttccatataggaacgtttcaatgtttttgtgggctacagggaagaagaagcccacagggaaagaaaagatgaataagtagatgacagagaggattactgaacagacagaagaagaattctgagagatgagacctgggaggtttggctgagagcagaggagttttcaattaataaggagaaagagatcatggggtagcaaatggctgtcaagtagccaagagggctgagagttgacaaggagccattgcatctagaattaggaaggcctcaagagtggaagtggagtgggaagaggtaaaatagtgagttgatggtagacactacacatttgagaagttttgcagacccaggagcaggtagaacaaggctaagggagagattatgctttacggggaggtttgagatgtgtgtaggaaggaaggagttagcggaagagaagaggctgaaggtagaagagggtcagaggtttcttggtggctgaggtggcagcagcagaaggggccgagcttcagaacactagtgaggagaaccccagagaggatcccttttttcctttgaggtgggaggaaaggacaaaaaagccagaggagccgacgttctgcacttggtccttgaacctggccttgggcactaatatcaccactgttgaccccataactttcagggcatctcatgatcactgagtagatttgagggactgtctctgaggacagcaaggtgtgtgatttggagaatatactggcggctctttcc

SEQ ID NO: 1810 - DNA, 1700 bp, artificial
  synthetic oligo
aggacaggagctgtgtgtctctgcctcccttcgcgtggggcaaggggctgcgggaccagcggcctctcttctggcaggagggggggttccccggaggccctgcccccttcgtgacatgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtggtgagtggggcccaccgagtcggggggctggggtgctcggccgggggcggccggcggctgcagccccctctgggcgccctggggcttggctggtcgcccccttgcctcccttcctgctggcttttagctaattgttcctggctcaagggactgccccgtcgaggccccgcataaatcaccagctttgccgggaaccgcgagcaatcgcgctaatggctcggcggtacgcgggacgagcgcgtgggcggagtcgctggctcagccgccggcagggacagccagagccttggggccagacgcgcaggagcggcgtcccgcaactcaaggaccctcaaggcccaaggatgaatgtccctgacagggcaagccaggccccagggaccctgaaggaggcgggtattcattttgccttgaagttcgtccccttgtctcaatctcaaacacagaatatcagcaatggaccccctagagtcgtcgaatttaaccccttcatttaagagatgatgacactgaagatgggaaaagcctgcccaaggttacccaacaggttggcagcatacctgggtcagcttaggctctgccagctgcccactgccccagactgcccagtagtggacccctgcggtctttagtcgggttctttccttgggtacttgagatcaatgcttggtttccctatttctgtggaattgaggacacaagtgtgcaaagatcacagcaccggcatatgtgggtcacatttcaccccttttcgggaactgcttctacaaagtacattttgacaactgattatattttcatccttaaagtttcaggagactgatattttctttttgacataccccaggacccccacccacactgtccttcactcccccttgataataagccccacccccttcaggctgccacctgcccccacagccacctgttttttcatagtctccacctccaaaatctatattggtgagagtgcgtcattgggcaccagccatagaccaaacctggggttgtctcctctttcctctgtcccttcacaggcgggggaggggaagcagggaaaggaggggcctcagcaacttaattcagcagagacctgtttttagttcttgccagccccaacaccctgctgagaaccatcccaggagtttgacctcctgctgaaagactacagcttgcttaggcagttcaagtacagcctcaggccagcaacaagatctctgagaaggaaaaagatctgcatacacacagagtttaattttttcttttgcatatttttaaggtttatatgatcctggtgaatcaaaaatataagggagttttataagatgtcttttaaggccttactgctctaacagtataccctgaaaaagggggtgggg

SEQ ID NO: 1811 - DNA, 1100 bp, artificial
  synthetic oligo
tgggaccttgaagaaactaaagggtttgacagcataattgaaatggcaaagtctgctttcatctttagtttctctagtgaaagaagtgactctatgtctccctgaaagcccaaattggagaacaactaggtcccccagaactggtccagaaaattagggataaagaagtgccatttttcagtcctacatcaccattattcaatttctagtggttagacaaagtgtacccagcatggaattttgaaaggcaggcagatgagcctcctccacagctttttgttggtctacctctcgtcttctaaagaatagtgtgctgggggaagtagctaaaaatgaaaaacattgaacaaagggtcacaagttacaattgtattaaagactttgagtcagataaggccactttgagtcagataaggccaagtactagctggaaacaaagaaagtaagagactgacaacatgagcagtttaccatgaccttctacttagactctgggataaggtctctgtgacgggtactcactgaaaattgagagacaaagaagtaaacagttataatttggggtggaaaatgctgtgaaggaggtaaatgcaggattctacaggattacattgacacctaccaccaacttaaagaataacggtaagcagggagggcttcttttaagatacgacatctgaaatgagtttctaaagacaaataggatttttcctgatgaagcagtcattgcaggcattacacctggagagaaaatattctgtccaaaggcatgaaggtatgaaagaggagaagcatgtgctaactgcaagtagctctgtttggctggactgtaaggtctgaagtggtgaggaagagatggaaagatagggaggatagtgcataggaaggtaacaggctgcagcagtgagccagagccggatcatgaaaggccttctgtgacactatactgggagctgcgtataggccatgactcttaatagctaagcttcatgggaacagaaactatgtatatttcatttgtgggttcatccccaatttctctaacattgtacatagcacaaaatagaggtcccaatagcagcatgaatgaattccatgcc

SEQ ID NO: 1812 - DNA, 1000 bp, artificial
  synthetic oligo
tgcacattagaccacagtggggtttctagaacatgtcctgtccctacataggagaaactatgggtcaaggtatctttggtcctagatgcagagaatagcagactctttctgtaaaaggcctgatggtgaatgatttaagctatgcaagccacaggtggcctcggtcacatagcctccattttttcaagcaaagctttaaaaatgtaaaaatcactcttagctttcaggccttacaaatacaagtcactggccacatctgttctgtgagttagcttgccaacccctggctagacattcattctcacctctcaaatccatcaaagccctccctcctctcctgggctttccatagcacaagtgcaggtttataatgaatttcctcaccatgagtacctgaaaagagactatggaattgagttttgtgtacactgtgagggagaagtaaagtttcatttgcacgcacggatgcccagtaatcccaagaccactcattgaaaactcagtcattcccccacagaattgaaatgctgcagctatcatatatcacatgttttattttaaaagctatggctttctcatcagtgactatggaggctacaggacagtgtcacgtcctcttgaaagtgctgatgggaaaaaaaatcaacccagagttctccatccttgaaaatatcttcacagatgaaggtgaaataaatgttttcagacaaaagacaactaagattctttgtcactggtaggcatacaataaaataaatgctataggacattcttcaggttgaagaaaactacatcaggggaaaatacagatcttccagagccagaacatgttccagagtaaagaacatcagaaatgttcagtgtctgagaatgtacaaaataaattttcacttagttcctttaaaatatacttgaacgcttaaagcaaaagttctaacatcattttgctgtgtttataatgtatgtacataaattacaaatgacaataatagtataaagg

SEQ ID NO: 1813 - DNA, 2150 bp, artificial
  synthetic oligo
gcagccctgttttcagcagccccatcaacccactgcactgaccccacttctctcattcctttccaggttcctgcatgtagcctctggggctctccatgagcttcacactaagtccagtttcttgaactgctcaatgaacacttttctataaggtcaagatgcagagaataaaatccaaactgctggatcttcagtaggtcaaaaattagttgatacacactttttattttctttatggtcataagaaaattcctttctagactaagtggctcatgcctggtaacgtcagcactttgggaggccagagtaagaggatcatttgaggccaggagtttgagaccagcctgggcaacatagtgagaccttgtctctacaaaatatgttttaaaaattagcgaagtgtggtggcacatgcctgtagtcctagctactcaaaaggctgaggcggtaggatcacttgagcccaggacgttgaggctgctctgagctacatgtcaccactccacttcagtgtgggcaacagtgtgaccctatctctagaataaaaaaagaagatcatttctagcacctttgtctcaccctttactatgcaaccttgcccaaaaactgtttattttgcttacgtgtatacctgactcccacatcctgcttgtttttggcatatactaggtgttcaataatttttgcttaaggaaagtaattgaagatactttataaaatggaacagataacatcatatgaatgtattcttagtcctagatctggtcactcccatttgacttatcaaatccctaaaaagcagtttccagggagacttgcctttcagccgagctgccccattttcctattactttgttaactctaaactgccaatcagatttcttagtgttttgcctttagtaaaaaatgattaaaactctggttgatttcttcaaaggcaaaagaaaagacacaccatcactcagggccagccggcttttacaatttacattcaaacgatttgcagaaacaaccaaaaaaattcccagtgaacagaaagtaaacgaatttattagaaagctacttaccaagatattggcatgaagtttgatgagaaaatgctttctcttaaaactcaacttgcggattttagcccagttaaaagtattgatctttgtatttccctacaatgaaaaatgtggcagatttcagaatgtattaacaagagttggcttgtaagacagtgcaaacctgatagaaaatgcacttaatgagagggaccgcccttgacccatctcttgcacagattgatcctgctgcactgggtaggagctgtggtcaaagaaggcatttcaggtgggatacaaggatgctctggaatgcaagcaagaaggggtatgcctagggaagttttctggccagcacagggagatcacaagaggaaaggattactacaatagcttttctaatctcgcccctttcccatgtttcccgattcatctgctaaaaacaatgtcctctttctcctgacaccccaatagctcaaacaccttcaatagctcctcactgcccacatcacatcatggccatatcttgctgcctcatctatattgaatatataacctttgttcccactaattccaaaacaccctttcatctaactctatacctctctcctgcagtctcctcattttccttgcccacaatgccttccacatagtcaagccttcttgccagctctgacagacccttctctaggctattctgtttaattactgcagcctacacccatttccaactcctctaaactcccttggctttcctggtcggtccaaccagctttgcttttttgcttatttgttgtttgttcaacaggtaatctattcgcgtggtctgaaaatcagaggtatacaaaaagatatatatagaaagaagtctcactcccaccactgtcacccctatttctgtccccatctatccattccctgcagttaactatgtttattagtttgtcatgtatacttttcatgcaactacaagtaaatatgattgaccatttccctttctggctggtgataatactgaggggtgagatcaccttgggaaaggacacccaagtttgagccaagataaccacccctcactaaagctgaagggcttgaaaggaaaga

SEQ ID NO: 1814 - DNA, 1450 bp, artificial
  synthetic oligo
ttgtctgtttattgctgtgttcccagtgcctataatagtatctggcatgtggtaggtacatgatacaattttcttgaattaacgaccaagaagagttactgagggagttcataaaagagggacacttcatttgaaatgttcagcttgtgtttgggagggagtgtctggctagaatagagaggtgtgtaagtgtaaacaaaggagacgagaaggttggaatgtggaggttcttgaacgcttaaaatatagcaggtatccaacaaatattagatgaatggaaaattagacaaataaatgtggaggttcttgaacgcttaaaatatagcaggtatccaacaaatattagatgaatggaaaattagacaaataaattgcacaactagagcaatctagttgtgttctgcatactacgttagagtttagtgaaatagtctcactgcaatcaattgcgaagaactacctagttggaactttagcttttttccatggaaagagtttctactgacagacaatatcctctagaaaagctcaagtgctctgtgctatgcctgaaacggccactagggaatgctcaaatccataaggcagaactgttaagaatgaaattgagctcccccgtcagagactgcctgggagccccaatcctctgactgctgcctcaacaggcagctagtggagaaggatgtcttctagcactgtttcctctatctgctctaccctatgctcccaccccagtgccaaagtacaatactggacatgacggttagtgtcctcggcattcaagacccttcaaaatggtgcattttccatcacctcttctaaacaggccctatgtttgggctatactgggtcatttttcatcctctatatacgtcacttcttgtctaaccaccatttttgttttcatgctgtttcctttactgacaagtacttatccaattcctatgtgtccctttaaggcccagcacaaaagccaccttctccaacagccttccatgattaccatttctcttactgccctctgcctttctgagatcctagggctctcattgattgtccctgccaggagtcacttggtaaacacttattcagacactgtccctatctaagcactgcattctggggctcccggtgaaattagaaatctgtcatttctggactatcagaaaggtaaggtacagaggtcaaaaatgaacttaagatacaaaaaatgaagttatgatcctgcaggactggtaagaaacagcctattctttggaggcctctctagaagggagaaaatgtccagctggctttagaagagatactatctccagctgcctataccctgcccttggggctgtagcagcagcctggcctgccaggcatcaccccctccctggaaggcccctgctgttccccagaccaccttctacctaccttcgttatgcagcctagtccagctacttgt

SEQ ID NO: 1815 - DNA, 3750 bp, artificial
  synthetic oligo
ttattaaatctaatcatgttgcaagggtgcacatagtttttcatttttcaatcagggaattgaaccctacatacctagctgcaaactgcatttagaagcaatgctagacacaaagaaccctataatgaaaccaacttacattatttccagaatggctgcagaattctaatccaaaatattccttttcagcaagatttagatggctgcaactcaggttaaacaatgccttcccggatgacttttgctaaacaaaacaaaaagatgatagcacaatttgcattcctaacctgatactgcagcacggaataaagggtagaagccacaagactctctgcaagccctgtttcctttaagcactgtttagaggacctgcatccttttcaaagatgttgacctttacagatagatccacttatctgtctctgtgttgttttagcgacatccctaagaaagccttataacaaaccaccttggaaaaagaaatacttgcacttaactatggctacatctgcaaatttaccctttcaatggaattcttgaatcagttcatcccatgggcaatttgaatgatttcttccaaattgacagatagtttagtcaagatgtaaatccaaccctattactcccctgcttgaaatccttcagtggcaccccctcaggataaagcctgtactcctcagcacaggagacccagttctctctccctcctgtggccatgcctgcgcctccagcctcttgcccacctcctcctgatactttcctctctaataacggcagcctgctcttagttccccatacctgtctagtcattgcgtgcctgcatgcctctgctcatgtcatccttctccacctatcgctctttccacatttctttggtttggcttactcctactcagctcagatgtcatctccccagagaaggtttcttcaatccctatcagccgcaggctgagccaagggcaagctcccctatgcctccaaacaccctcacttacctcaagcatagcacttcttgccctggatgtctatcttccccattagactgaattcctccatagcagggactttgctttatttttcttgttactcaccagttctaattcagagcctggcacatagtactgggctcctgaatgtttgttgatccaacatgaaattgaccatatgattatatgagccccttgagtagatttcattttgtagctttgcccaccaaatctgcatacagcatactctgttcacataaggccacaaatttttttcttcataaagcccacacacactgtgagcacaaaacagtccctttcttatgcttctctgagaacaggagctttgaagagctctctgtgaaaaatttctttgagctgagtatggctgggactgattttcagcctgcctccactattgctgaacccagggattgctgttgcagggaggaccgtgatgggaaaattgagccctggctgataggcacaaagactggctgctgaaaacccctagttaaaggcgagtcacgcggtgcctacagtgctgcaaaggaagccaggcgcggggaaatgtagttggaaatcaccgacccatagaattaacagcaaccttgagaggtcagagagtccatccaccaccaattcccccctccctcaaggcagcaccacactgaacagagcccacatctgggatttaatagttttcaggaaggcggcctacctcacccgcttcccccaccgtccaaaaatacacccctctccccatggacttctctctacttggttttactgcccagagctccaccgactcaagattcatttgggttaaccccagtccgatttttaaatgaaaataggctgcaaagggtgaaacttatttcatcccttgcacctggagacagagctgctctaccaagggaaagggggtttgatttgatgtgggagatcacaatggagctgtagtccaagaaaagggggtcagttcccctggggggggtggcaccaagggaatggggttgccagggagggcctgtttataggggagaggggtacatttttgcctgtgtggcaaccttgcctagggcaagtgctgacacagaccattgcagacacatgaaattgctcctatttttaaaatccttcatagacaaggagctgccatgggatttttattatgaaaaaaaaaaagaatttctaaagagagagagatgacagcaatactttttccaacaccaaagaaacacttcagtcatgaggaccaaattccatcatacactccagtttttttttgcaagcaatttaagaagctcaagattttcctttctccttttcatattttattcttattttccatcagggcacttaatcctccctatcaacactgccatgttccatgtgtttgtatatttacatgtttctgcaattacaaagcatatgtagccattcttttaaggtttctaattaaggccttcgttttgcttccttccgtaagatcccatactatgtttataagaataattccctgattcttccatccctgtaagtgttgccaactggctctaaaagcctttggcatttatgcttttggaggtcagacactcatgtggctcaagctttccaccccatctccgcgagaggcattttccttcagtcctccatagtgtacgttgaaattggccagctttgtggaatgtgttatgtaataggtaaggtcttggttctgtctcaacatgcagcctttaattttttctaccattatgatcgaatttctcaattttggtgttatgtttctctttcttgtaatactgccttatatacaagcttcctgttttctctttctcttttctgttttctctggacttctgattctctgtacaattgcttggtcttttttaagctggtacttttcaatatcctaatcaagctccttagcagatctaaattctttaccacccgtcagtcctcccactgaaggaattggaactccaatcctgaatcctgtctcatcctgatatctgcctttaaatgtctatctatctatctatctatctatctatctatctatctatctatctctataatttaaacaaatcattcataacttggatttataatctttaatttattgggtcataacaattgaacactgattcctgggggcttcaaactcatcttctcatggaaacaataatattcaaagtggctagctctaaaaacaaatctaccaaattttctgtgcaccaacaattgttatataccaatttgttaaaataaatcgggattgtaatcttgctctcttcacttactagctggacgaattggggcaaatcatttagctcacagattgatctacctcttctagatatctgaagataaaaaccacgtgtttgaattcttggaattaagtacagtgcctggcaaagtggacattcaataaatgtttactgagtaagtggataaatggacccagacatttaacttgattcatgtacattagtataatagtcctcttaagagagagacaaactagtcattatgtgaccttgggcaattactgaacttttctgagcctcagtttactaatctgtaaaataaagataatagtgatattatctcatagggttgttgtgagggttaaataaaataattcacatcaaggtcttagtacagtgcctggcacatcatatgcacatgcacatatgcatatgcacttcagcaatgcacatgtatagatatatgcatagtaataaatctggaagaatat

SEQ ID NO: 1816 - DNA, 1600 bp, artificial
  synthetic oligo
accaccatgcccagctaatttttgtattttttgtaacgatggggtttccccgtgttgcacaggatggtctagaactcctgggctcaagcgatccacctgcctcagcctcccaaagtgctagggattataggtgagggccactgtacctggccctaggtaaccaaatgttagaaatagccttccataattcctgaagcagaacaattagcataaacatgttatctgttaacacagctttttagtaaatgtttgcacagtagcatttcgctagttggtttgggagaagcaatgtccaattatcaggagttgggtcatgagggcttaagcataaacggccatgacttgacaaaagtaacagtccagcagtatcccatggagattgagaaccgatagaagtaggactcaacaaaagaggtggtctgtgaacttcatgactatcatcacctccctaagagaagaatcttttaaaaacaccatagtgccattcagaagcaagtttactcagatgacaagttgagtgctgtaggttcgacactatcacaaagcagagaaagtctccaaatgatgagaaaagatcaaccttaacacaaaatggtacaaagtgttcttctgaagcatttcattcccctaaggacaaaggcaaatgagaacgcacatgaactgcacacaccatttcacaaaagactaccccaccgaaagctcagtttcagaggaggttttagttaaatgaccgtaaagtagatatattttgagatactgcaaagtggaggtgaagatctgcggccctaggcactagggtttgactttttcagtgcttcaaatgtacaagtcatgtttctttcttttcttttctttattggcaatttatttttggttaagcaaacattattcacaaaataaaactaaagggtttcaaatacaaattaatatgtggctgcatcatgtaaacatgccaataaaataaacacaacaattctattctgtgatttatcattaggtttctccccagctttttaaaatgagaagatcacctgagcccgggaggctgaggctgcagtgagccattgttactgggggtccttgttcttagagctcctaagatggtggccggccacttccaagatggtggcaagcctcttgttctctgacctggggttcttggcctcatggattccaaggaatggaatcttgggccatgcagtgagtcttacagttctaacagaagccatgggtcacagaagagaaccgtggaacccagcaactagtgttcagctcgattaggacgaatccgggcactagccatgcaggaacaatggcaagcctttagcccgatcgggagcggcaatgggtgcctcgctggatcaggagcgcagcagacaccctgccggatctggaggggtggaagtcagcggcgggtctgcgacggcggcaaacagcagtggtggatggcgagtgaaagctcagctcaggccgtaacaaacatggaccagaagagtgtgcagtagcaagatttaatagagtgaaaacagagctcccataaaatgggaggggacccaaagggggttgccattgccagctggaatgcctgggtttatatccc

SEQ ID NO: 1817 - DNA, 1100 bp, artificial
  synthetic oligo
gtactatttttattctaattttgccatgggtactgttatattttacttataacatatattaaaatgataacaagaaagcaggcaagtcattttttcctggtaagttagaaagacaaagccaaataagagactataaaagatgttaatggtgcttaaaatattaaaaaaaaattgtagcgaagtgattttaaatatcatttaaataaattggtaaaataataaaattgaatctcattagaaaactgtttataaatgtttgagctaatttttcatttttcttatttttcattttaataggctaaccttatggaagtgaagattgactcatataaatgtgaaatgtctgaatatactatgtgtgtgtgtgtgtgtgtgtgtgtgtgtacatatacacacccttttgttctcacagttgctacatatgaaaatttgaaggtccatgtgtggcagctagcaacacctacaatacgcctttcagggtacaaaaaagtcactaatcctttcaaagggttataatagtcaaataattaaaataacttcatttcttttgggttccacacatttagacaccagcatgattcttgcccagtcacctgttatgtagcattccataagtttctctatgctccacaaagatagggttctgtgatcaaaggatttacagaaattcttgggttcaacagaactaaactacactaacacgcagttaacagaactaaactgtctttcatgcaatacctctcagagccttttctcagctaaaaagcattgtgatgctccttggagggaaaatataataggtctcccaaagaaacattaagtcttccagaatagacatcatttcccttccaacagatctgaatatatatcaagaaagggccgtttgaacaagtggtgaggaaggaggaggcattagaggaacaacacagaatcctgagaattatgaagctttgaaacatcatccttaattgacaccctgctaaaccaattatggttttctctaaactaatggttcccaaacttcagtgtttgccagaattaccgggagagtttcttgaaacacaaagtgccaggcctccccacagagtttctgattcagt

SEQ ID NO: 1818 - DNA, 1100 bp, artificial
  synthetic oligo
aagcagtcaggcagagttacttcaccttttctccgcctttttgttatattcaggccttcaacaacatcaaactggatgaggctcattcacactggggagggcaatctgctttacttagtctaccaatcccaatgttaatctcttccagaaacaccttcacagacatatccagaaaagaccgtggagactcttgaactctgtgctaaggcattagcatttcctttggctggcaaagagacccatcaaattttgggtgtttcgtttcatagactgcaagacatgtgatttttgtaccatgccaagtatctcaggacttggccagcgtgcttcattaccagggaagcacacagtgaaagagttgcccatgtggagtggttttgtgactatgaggaaagtcaaagtgagagcaaagataaccagtgttatctagacacatctgttaattaagaaaggtagcaatagttatttaacaactagcttctttgttaaatgaatgaatcctgcaaatgcctactgccttatattctttgaaaagaacattgtggatggatttggattgttctagctttcctaaaaagtagttatactgacagtacatttttaaggtaagacctagattggaatctcagctctgcaactttgcagctgtcagacctttgacaagccactccaaatgtttgaatctcagttgtctcatctgtgacatgattataataatagtgccgactatacatagtaagataatgaggtaatgcaggaaaacatccttagaatagcgcctggcttgtagcaagtgctcaattaatgtcagccattatcatcagccctggttgaaagtttaggttttactggactaaaacaactttttgtagtaagtgcattttatttatcgttgaaatattaatatgaatgtactaggtgaagagtcacattcaaatgcctaaatcaaagtgacaaagttttgttgtttcacaaactttgtttaagatgaaggttcccatgtatctgagttgcctctcctgctcctcagttgacccatatttctgagtattacagtgagctattgcaattacattgatacatacattttcttcccattg

SEQ ID NO: 1819 - DNA, 1050 bp, artificial
  synthetic oligo
cgcccttgccaggcgccctcttcacccactaaatcagggtttcttggcaggtatcgttaacggtagcagccaccgaatacacgcgcaaatgtgcggaagatacggtgcaattatcttgctttctcctctcattccaccgctaatgagaaccaattgagggcgggctgcttcaaggccaaagcccgacagcgctctgtagaataaaatgatgtcttagtttaagacgcacaatcaaaatggaattaagcataccagactttgaacaccgggcaaaatgagagacaaccgggctatataccttctccgcgtccctggcggacacaggcgcaagatgggatttggggagcgtgcgggggttgggggggtgggcgggggtgtgcagggtacgaggttacaaatcagagaccagtgagcacgctgggtcggaggaggaaagccctggaaggcaagcggggggcaaggaaggagggaaggggtgcaaaatgaagccggacccctccctttccaccattgttaccagggtgattgtggcagcccaaagcccagaagaggacaagggcgccatgtgattctcaacctggtgcactggtgcacagtagtagctcaggcaaacattacaaaagactggcctctcccgcccctggcccgcgaaagagtccaacctgaactgccagcgcccctcaggagtcagcggtggatgcaacgaaaaccacaatcatttctccaacgcgagtcactcgcacaggtgggcttcctcccctttttcatgcaacagaccttgcagcctaccctggcacgtctgcgtgatactttctggaaactacgcagcccgaagtttactacccaaccagatccctcctgtgagattgcaccgactgcaatgcaactttcgacctttaatggtaacgactagcagtggaaagaagaggagggggagggaagagaacttagacccgactttaagaagcgttgtattaaagcaagataagaacagtacctttgagctggagcaaaacctggagtaaaaaaaagggtttttgcgaaagtggc

SEQ ID NO: 1820 - DNA, 1150 bp, artificial
  synthetic oligo
ctaaaaatacaaaaaattagacaggtgtggtggcacacgcttaaatcccagcttcttgagaggctgaggcaggagaaccgcttgaacccgggaggcagaagttgcagtgagttgagatcacgccactgcacttcagccttggcgacagagtgagaccccgtcgcaaaaaaaaaaaaaatatatatatatataattatatatatatataatattatatatatatatacacatacttataaatgtatatgttttcattgccccaaatagcccaggtttgaggctactgaaactaggatcattttccagggcaatcaaaagtagcctattttgctgcatgatccaagaaaaaaatcacattacttctctgagtctcagtctcccacgtggtgaaatgagaaggttgggctccattgtatgactgtataattctattaatacaatatcaagtgctttgttgccttagtattggtaaatcttccagaggatagtaaacgttttctgacttacatatttgaaaacctatctccaagtctgcagtagctttgaataacaaaactctctgtcctaatcgttgttgatcctctgccatttgataccgatggtacaaggagtgacccaccatatttaaaaagataattacggcaagaccaaggtaatctttgtgccttttattcacgaatatgggggtggtgtggagttgcttggtgagaatctgaaactctacctgaaataaaggtttggaattctgggtctcaagatttctgactccattttccagaacacaccctgaattatcaccatcagtgtgtttgtatttatattttaggaaagtgatgaatgtataaggcaatataataataagaatagcaaacagttgtataggatttattctgtgtcaagtaccgttctaagggtcttaaaaacattaactcacttgatcctcacaacactcatgagttaagtccaattagtattcccattgtacaaatgaggaaagtgaggcacggagcaattaagaaagattcctttattataagggatcttacctccagcagaaataaatgggatccttttaaaataattaaaacaaatgataggccaggtgcggtgactcatggctgtaatcccagcactttgggaggccaaggcg

SEQ ID NO: 1821 - DNA, 2850 bp, artificial
  synthetic oligo
ccggcctatttatttattttttgagatggagtctcgctctgtcacccaggctggagtgcagtggcatgatctcagctcacgcctcccaggttccagcaattcacctgccttagcctcccgagtagctgggactacaggtgtgcaccaccacgccaggctaatttttgtgcttttagtagaaatgggtttcagcatgttggccaggctggtctcaaactcctgacctcaggtaatccgcccacctcggcctcccaaagtgctgggattacaggtgtgagccactgcgcctggcctaagtctaagaagatcatttattgattcaacaaaatacaatgtttaaaatctataacacagtgaaaagcatgggcttgtcacccaaccaaatcctggaagttgtgagcaaactttgaagtaggaagacagtactttggggacaaataaaaggaaacaatttcacactgtcagtagtgtggaactagttgcccccaatgggttttaaattcaagtagggtgcaagagtggtttagagaaattcctgagtggcaaatgaggaaaccatgggctctctgagatacaagcccagtcttccgtaggggcatagccacggcacaatgctctcctgacctaacgtccttaaaaccttggtcagaagtcagaccattgtgctaatgcgtgagggtgtgcgtggggatggagggtggggtggaactcctgcatagttagcaaccctgcaccaaatcctggcaaccttccagagcaaaccctccaccatgtcatgctaataacagcagacctaggaactgaccctatgccacgccgtctggacccgcatacagtcatagtgtccaggtggctttgtgagtcacccagaccctccgaaataatcccactgcgggtggggctgccttgcagtttctggccccttcccaccctgactcagctttccttccacgagctcctatttcttgccgggcagaagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccaggtatgtctgcggacgggaaagcccgggctcccccgggctcgcccctcttcttcccggacacagggggcgaaggggcggggagccaggggcaggcgcccaggtccgcaccccaacccccactgcaagttatttctgtccttagagccccaggccggggctggagagcgtttgggagggaaaggaccaggacgtgggagtggcagtgcggaaagaggagtggggtcaggcctctcccgccgcccgccagcgactaggtcgggactggggaggtggaaagtgtcacctgcaatggggaccgaagcagcgccccgaccccgagccaccttctctcctcgggaggcaacgatggcaggagtttcagttaacaatttacagagaaaactcccaaactatgcatacaaagatacagctttgtagcaagaatgtgactctcatactaataaagtctcagccttcggaattaaggtgactccccgtatcttttcttctagaaggaataacttcacactaataacaaagaactggggagtaataagcattcacggggcccagttttcaatggtacttttcttccccctcaatagctgccaagcaatagagaagacaatttgtcccgggaagtggacactttggcccatatattaggaccctgacagatgaaggcaaaaatcaggatgacttcccttttcgatgtttttttgtttgtttgtttcaaattaactacactctgagggagggaggcaaggcctgggctccagccttttgctaatgcggttcctggcgtgctcattaacaacaagccagggtggctcctttgctcaataggtgctaaaagtgaggaggtactgtgttgaataaaatttcctcatgattcttgtcccatttgatatctgtatggcttggggaaggaagacttagtggcataatagttggggaaatgggttgacaaaaagagaaattacctcttagtgtctggtatcacatttcagatagaccaaatgacattctaaatatatcacttgtctttttttttttttttttttttttgaggcggagtcttgctctgttgcccaggctggagtgcagtggcgcaatttcggctcactgcaaccttcccctccctggttcaagcgattctcctgcctcagccgcctgagtagctgggattacaggcgcgtgccaccacgcccggctaatttttgtatttttagtagagacggggttttgccatgttggtcaggctggtctcaaactcctgaccttgtgatccgcccgcctcagcctcccaaagtgctgggattacaggcgtgagccaccgcgcctggccatcacttgtcattttaatctacatctcagatataaacacgggtttgggcattctggttaaatgtatttcctgattacagggagggaggcggaattttcttttttccagttcaaactggagaaggagggcagagatatccagtagacagaagatcttggaccccaggaagtgtaagtacagtcgtgttagctgttatctttttggggtgtttagaagcacagagccttacgcaacataactcttcagcctt

SEQ ID NO: 1822 - DNA, 1000 bp, artificial
  synthetic oligo
aagcttccagtttttccccattgattatgatgttagctgcaggcttttcacaaatggtctttactgtgttgaggtaagttccttctatacttaatttgttgagagtttgtatcaacaaaggatgttgaaccttgtcaaatactttgtctgcatctattaagatgatcaggtggtttttagcctcattttgttaatgaggtgtatcacattgactgatgtgtgtatgttaaactcaccttgcatcccagggataaatcccacttggtcatgatatataatctttttgatgcattgtcatggaattcttgccacaccaatctgactatataagcctttccatgtgcccagctctgtgctatattcagttatactcaataaactcaatattcaaaaacgaatacccaataaacatttcctgctaacacacgaattttacttatttacaaaccactgcattttcacaaagtccttaaaacttctggacctgcttgtatcattgctgcaataagtggcttctccagcacctgctctgcttacctcatatggctgttttgaggataaaatgagaacagggatgggaaggccctttggacactattattgctgctgggtcaaagcaccgactggaacttttgagctgatgtgactgcaccaattgttcctcccttttccctacatagaacttctgggtttaatagtcaaacatggtttcagggctcctcaacagtttctagcagagtacaagtgttgaacaggccaaaccctatgttttgaataaagtgacaaaggtccgactgtttttgttcccatgcccatggatggaccactgagcatggccccgggcagcaaggtagctcccagacagagctatccatatcctcaggaaagagctttggatcttcttaagaacttgcttatcagcacaggtaccattggcattgctatttattaagcacttactatgtttccagcacattatatacatcatctcacttttttt

SEQ ID NO: 1823 - DNA, 1000 bp, artificial
  synthetic oligo
atgtacagttgattaattggtaaggttgatcaaatatagctaaatatataggaatttggccttggtatccagtcttcaagaaactttttgagtagcttgaggataatgcaagccttcccattcaagcgtgagtttttaggcccaggaagggaaaggaggagtagaattattacatttcccaagaaatttcccctagtccccttccccgatgatcaggcttctctctgcatagcttaggtcaatgttgcatgacaaatcttccctttacatacggttggaccaggccagattttgttagcatgtgcaaatagagccaaacctgtcaacttacaattgtgcaaaatctgactcctgggaatcttccagaagtgagccggggaaaactaatatctgtcctacctacctcacagggtcatggtgagaatcaaatgagataatggatatgagcacattttgaagagtagcaatgaaaagcagcttgcttcttgagcctggagtggagcagtaggagctctttggtgatttcaaggccaggtgaagggtggaggctcttctgaaattcttggactcatcatttcccagtggttgtaagacttgctttccggcaattcttgggaaattttactttattgtgagacttctccaactacatgggagtttgtccttgacttcccttttccgttttctaattacccttactcagctagttcacagtactttgaaggattctacaagataagctaactttccctccttttggtgcattgaaaagacagtattttgctggtgacttacatttagatttcgaatctctctccaacatcaggagcaagtgatacgggaaaagcacactctgagattgatgacttccacgatggtctataaatgataattagccactgaatgttattggataaataaggagtgcctctctgcttcccctggagagaccaaattccctcagaattcaagtgttagaagacacaagagaacctagaaa

SEQ ID NO: 1824 - DNA, 1000 bp, artificial
  synthetic oligo
ctggcgggaataggggagtggaggctgcctgccgaggcctggtgcactttttgtgaccggagcagataagctccgccgcacatactgctccctccgctgacattatgggggcttctcttacacctccatcctcaactaggccagcagcagcaggcttcgtcgcccgtggctttgctaactgtctcctgagggaagagggtctcccactttaagcttgtattgtcccagagatgataagagatcccaataccaggatgtgttcctgcattccctgacaaccagtgctgacagcaaaaacatttctagacaacttcttgtgacttaacttttatgtaggcagcatactccccggccctgccctttacagagcacagaatgactggacagaatggaatgctcatcagatggaaagacgcaaaacctatctcatttctgattgtggctttaatcaggtccattgtctagtctgggtctcagtgtccttattggagccaattttatgtatgggtcccaaacagcactgatcacagaacttcttgtgcagagtcagcacagagtagtggttaagaggacatactgactgggtttgaattctgactctactacttcctgcctgggtggccttgggcaaagttactaaatgtccctgtgccttcgtttccttggcagtaaaactgtaatactaaaattactattaaaaggataaaatgagttaatatatgtaaaatacttagaatagtagcagtaagtgctacataagtgtttgttacaaactgaacttgttcaaaatgtagatttgtgggcccgccccaggagattttgatgcagtaggcttggaaggggccctggaaatatggattgttttaaaagccctctgggtgattccgacgtccactcgctggatagtccttaagctcctgtccagttgtgcactgggagagaggttcattcactcaacagatattaactgaggggctactgtgtgccaggcactgtacta

SEQ ID NO: 1825 - DNA, 1550 bp, artificial
  synthetic oligo
cattgcattgaaatgtaatagttctgaaattgctttcaaaattcagccagaaataataattttgcctgcctcttttcaattatcccatactaaacttgccaaggccaattatcattttattcctcactgtttatgctttctgcctgcagtatgagggatttgtaagtacttttagatagtttcctttaaattgcctgtatttttctcccagctagattagaaacaacaacctctgtttttgagcaacttaggtatctctttttatctcaaggtctcagcaacccttaaggccagccccacctcctactccctgctcaaaagaaattataatacattcttttgttcacaatagctactaaacaatcatttgttgaccacatgcatgcactgacctcaggagcttaacaatttaggagaacgcgaggagaataatgctactttggccatcatttctaggttttattaacatcattcttgcctgctagttttttttttttttttaacctttcatgtaaatcttttgggaaggtttggggtgtttgtggtttgtagatttgggtttgacttgtatttgacttgctcttgtggtaactaaaggttacaacgtagcttcaaggttgtcatgacaactggtaaaataaagagctgattatcacatgtttgttggttcccttttataggtgagggcctgggacagacgcagcagactgggatatgcaaagagaggagtagcctaattgtcaagtctagatctaacaaaagcagtgtcccaagatcatggcatatttccctggaactggaaggactgatcaagaaacacagctaggttggtataataatgtgtgcgtagaaatggggagaagtaaaaacaatttctttaatgttgtgtttgccattgtagcatatagaattcttgctgtttttgtattacttgttccttttgatattccaatttgtgtatgtactatgagtcctatttatatctttacaggtttggggttcctgacatgtagctgttcttttgtaaaagagagctccttctctttgataatagctgtaaacttattaccatctcatatatttagttatttcatattactccttttcttagaaacatagtcccttagtcactcttcccttgtcattttattatacctattttcttagtgttgttgtacttatttaaaaattagatacttgtaatgcttaggcaggatgaaattttgtctatttattcaaaatatacgtatgaaaccttactacctgccaagaatactagcaaaagttgaaaattaaaatgaacacaatggaggtaagattcccttgttcactggcctgcttcatatttttctgttattcagacaatttgttttttgactctgttctgtctttaatcactgccttctgcattcatcctgaatttactcagctttaaccaccatcttttataaacgttcaggtaccctgggaattttaacagtggcttttaggacatcttgatactagcctgaattctcctgctatctaattatgtgccattaatctctttg

SEQ ID NO: 1826 - DNA, 1150 bp, artificial
  synthetic oligo
tgccaccatgcccagctaatttttttgtatttttagtagagacagagtttcaccatgttggccaggctgttctcgaactcctgacctcaggtgatccacccacctcggcctcccaaagtgctgagattgcaagcataagcctgtatatttagtacaatttttgactacaatggggaggggaaatgggtgaataggaaaggagattaaacttaaaaatgtgtattgtgaaaaatctattaaggtaagaaagaggagtaagaagaataagaggagagaaactgaaatatgctttaatgttctttgtatattttcgattaattaatggcagtcttcctaacaacataactaactcagcatgtactttttgtattctaagattaagggctagataaattctggaaaatactcttttccaaagtaagcacattgttttatgaagatgcttcggttactaagcttaggggtcttttacctgtgctgtgaaattcgggctagtgttgaaaaaatattcaaatatatcagcagtttaagagctgttagaagtcaagggtcaattgagtatttaaaataaagtacgcttaaattgaggagtgttttaccagattaaaatagttctccttttgagacatgtatacataaataggttatcacatgaaaagtatctcgagttttcttagaatttatgattgaaaaattatttttatagatcaattttaacataaaagatgtagtttctgcccagtgtcttcggagatgtgacctgtctcacacttggttttcagctgctctgaaagacgactgccttattcctttgaggtgtccctgagggaactccaaagcgaattctgtatataccacctagtccatattttcagtcataccccaccctccaaagcatgccctgtacaaatgtgctgaaaattcatttggccatttttggccagatacaataacagataaacagaaattgaaatttattcatatattttggaatatgcatattcatttgggaaacaacaaactatgtcctatttggaccccattaatacaaatgaaatgtgggagaaaggtaccataaaaataaaagagaggtcctgaggcagggggcggggggaactaaaaagaatgatgattatgtgaagtgagatca

SEQ ID NO: 1827 - DNA, 1450 bp, artificial
  synthetic oligo
gatatggaaccaaaatctaccttccatcctttggtcctaatttgtcctagggaatgccacaaaataagcaaaacccatctcctctccaatagatggactttcagatatttggcaatggctatcatgtctccataaatctttcttcctctagattttccattccagtctttttttctttgagatagtttccagaccttgatactatcccattggcttctggacattttccagtttatcaatatgtttaaagtgtggcactcagaaatgaccacaacactccaccctttttctacatttcattctcagtttctataaattgttgtgttagagttctctgactaaaaagtaatttcggaatacttcccagttcagtgtgactgtactctgaatcctatcctatgattatgcagaaggagcaggactgaaataataaaaaagaaagaaaaataataatgaaaaaattaagattatatgagagacactcaattatctatccctccatcttttaatttctaaggttatatagatggataaagctttccagatcaatttctcatccagcctcctgcaattattaaaacattagtagaactttttaccaaacattgaaaaaaaaatgagagagcttctctactgatggggaaggcaaaggattctctgtagcttggacaaggaatttgaagaatctcttgtcctataccattttctactctttgtcccagtcgttggtaccagtttttctggcttttgatcaacattagagctgagttagacaaggtcaagctgcatgcagattgattggcctctcaactgagaggcaccccacaagatgatagtgaaaggccggggttcatggtgatgtgtagaatatcatttcttgtccttggcatgttctcagctctcctgctaaacccagtgtacaccctgatcttcttaccagcctaatgagtcctttgctttttattctttttgccattcctcctacatagtaggcacttgttattaaagtgtgataaatatatgcaccagctccaaataatactgagcccaacgacttccaccatgcatatgggcctgtgtgcttagtttttcaaaagagtacttgcttaattgtaggtactgcatcttcgtacacaggatgctttatatttcatgcttgctaagcagaaataactttaaatcttcaattttgaagttttatatttatgcagcttttattttatttttatttttattttttatttttgagacagtctcactcactttgttgcccaggctcgagtgcattgtcatgatctcggctcactgcaacctctgcctcctcagttcaagtgattctcctgcctcagcttcccaagtagctgggattaatttttgtattttttaatagagacagggtttcacatgttggccaggctggtcttgaactcctgagctcaagtgatcctcc

SEQ ID NO: 1828 - DNA, 1300 bp, artificial
  synthetic oligo
gccttctgaatagctgggactacaggtgtgtgccaccacgcctggctaatttttgtattttagtaaagacagggtttcaccatgttggtcagcttggtttcgaactcctgacctcatgatccggccacctctgcctcccaaagttctgggattacaggcatgagcctccacgtccggccctcctgtatatatttctttattggctcagattccgtagggaaggtgattaattagcactcttgatccccttccctattatgtacatagctttccattgaagaggatcccattacaccacacacacacacacacacacacacacacacacacacacacacccctttaccttaaggacctatacctatagggtatagtccacaactctttatctgagattcacgttcttctcaaacctgcctctccatacttatcccctactgtctcctgaaacaaaccctttgtttcagtcagaccacttcacccaattatattccagacactggatctctgcttagccatttcctctccctgagaaactcttcccactgttccctgccagtccaaatcctaccatatttcaaagccgaggtcatctttctctgtgaaaactctcctggacattcgtacacagagtaaatttatttattacctgtagcataaattaggattaacttttctctttctttgtctatacatccattctccccacaactagatttgtgagtccctggagagcatgggtcacattttctctctttgttccctcaaagcttagcatgagttagaatctcaacaaatatttgtggctagaatttatcttctatttccctatttcagaccaccagtttcctgagctagtggttttaaggatatgaaattgctcctcagccaccattaataatagcaatagattatcttataaaaatactttaatagcttccatttattacacatttactctgccagtcaccacactttacctggattaactcacagactcctcataccaacacttttagagattcagaatgcttaggtaatttattcaaggtccatcagcccatatgtgtagaacagaaacctcttcttctacaacagaaaacaataatcttgaccgggtgccatagctcatgcctgtaatcccagcactttgggaggctgaggcgggcagatcatgaggtcaagagttcgagaccagccgggccaatatggtgaaaccccgtctctactaaaaatacaaaaattagccaggagtggtggtggcacacctgtagtcccagctactcaggaggctgaggca

SEQ ID NO: 1829 - DNA, 1300 bp, artificial
  synthetic oligo
ttgaatctgtagattgctctgggcagtacggtcattttcacaatattgattcttcccatccatgagcaagggatatgttcctatttgtttgtgtcatctgtgatttcttttaaagagtgttttaatgacatttgggaaaattggtttggataagctgtgaatacattattatttttcccatttaaattaatgaaatataggccactgctatccaaacaatttgatatccaacacatttttagcaacagattacatttaaataaccataggtacctatacactctttttccatacttaaagttataaataataacaacagcaataataacatgctgccacctaacatagttcaactatgccttgtagaagacacatcatactcaacttctctccaaaagatgcccaaagtctcataagtctcataagttattaaatccagctctaaattcaggattgttgaacaatgtttattcctctttaggtcatcaaaatcttgtactgatactctgtaatttatagactggattatgaagtttaactaccatcaatcaaagtatcttatataaagtggcagggtgaagaaaatgtcctacacacacacacacacacacacacacatgcacacacacacgcagacacaataaggaaaaaaaaatatgaacagctacttccaccttgtttctgaaagtagtcacaaggacatagttggtagttatgtaacttctttcttcaactaccgattccattttcccttgccttcttccagtttcttagctatcttattctctttgcctggtgggctgagataaagcttcattactgagaggcttgagcccttgtggtctcaagggctctaatcttttattaacatttaccattgaacatgacagtattaggaggagttccagagtctcatagttttacctgcctgccctatgtaagaccaaccaattaaccccttgatgaccaggatcaatcacaccgatcaaacctatattttgcctgttggtccagtgacaaaaatagctcaaaataagtaggttgaagtcttaacatccaatccaatggaatgattgttttttctactggtagatgttatccttccttaatcagatctctaaatcagcagaggacaaaatcaaggggacaggaagaaaatatttgaaaacggatgttaaataggcaatataccattctagatgatgaagaataaggtacaactagtgtgaattctgtttaggcctttcttacctcctattgctataaaatgagttctttattcataagcagtatggtatga

SEQ ID NO: 1830 - DNA, 1300 bp, artificial
  synthetic oligo
aatacaaatctacaagtggaatcttctcaaacattttattggaagaacacaaatattttataaaatgcaagaaaccaaagtgacaaacactttgaaaacacagaaatgaggccgattgaggtgaactcaatggcaggacttctaaattacattatctgtagtgaaaaagtattaacgagacttaacaggttgtcactcattcttcagtctaatttcaagagcatgactggctcaactagggtgaggtgaaaggtaccaaaccaagtagctatggccagtcacataggaaacagaagggtgtggaaaggtctcagagaaaagctgcttcctggacagaccaatcagcctgagactgctgccttccaccccagtacatagatacagtacatacatgttttgacccgtccccgtatgtaaaatatttaaaaccatctcttgagtaagtactaaagcacatatcatgaacaatgaaaacaacccaaagtccaagccaatcccaaagtcaattcctgtttgtatgtataaatagctggtgtcatggggccattccttgagacaaagtcctccagatgaagtgcatggcttctgtagaactgttggatttgatgaaattcaaaaacctatggactaaacgttaaccttaaacactgccaatgtaaaatactacatgtaaattgaagaatcaaggcaaaaaataatatggaagcagtaatggcattacccatttcccatggagaaccattctcctttccttgtgttctaaaatctaaaaacatttggtgaggagaattcatctgtaatcataaaaagttctatgcttacctctaaccccaggttcccagatccaccatttctggactttggagaagcacaggtgcttgttttctggcttaaattatattccacatcctgtagatcagcatgttgactgcagaactagtagtccaagctgacactggagtggagtctacaacaggcctttctagcattctgtaaggcatcatgtctgactgatggggagaccgggaaaatccatgaatcccactaggattcactgaatacagcccactgctattcttttctcaaattaagcagcactacactaggtttgcatgtgaatacgaaggtacaaagaaagctcagaagaccaacacaaatctaaactgttgggtggccaccctggcagctgtcagcaatccatatactgcatgactggagtcagcacaatgggctgagaggacaaactccaatccagagggatctggaggaactgattcaaactgtatgggagtgcatacat

SEQ ID NO: 1831 - DNA, 3550 bp, artificial
  synthetic oligo
gtgggcactatatgcacatatcacagcctttgatgtgcattgttgtcctgtgtcctccaggtatgctgctccaaaggtactgtgagaaaggggaaaaaggacagaaggcacttccctgaatcctaatgcccattgcaacgttcacatcaaagacccttgtcctctgaactgtctgtattttcctcatgtgcaggagattcttgacattcctgcttgaactgttaggtagactgaagtagggaaacccgctcctcttctcaaattgtggaaaaggattggcagcaaaaatgtatggcctgcacaagaactaggtaaagagaaaataacttaagcagttgaaaccaggatctcagctcagccctcctgagaaagatagagggaaatgtgtatcacaggcagtgctcaagacttgcaaaaaagctataggaaaacaccctggattatcaccaaggtgaaggcacatagtgcgtcgcatcagtatggatacaacaaatcagcaaaagcaagagcagtaacattgcaggagtcctccacattatagtactgtgtaacaatataagtgagtgaagggtcacctatctctgtggccatttttcacaggcctttagcaatacacaaaagaaggctgatgcagcaacgccttcaccaacagacaagcccaccactcagtgggaaatggaaaataagaacctgcccccatcatccatgtgtgacgtttgccagtagaccatgtatgctcatatcacatcagtcgatatgcattgttgtcctgtgtcctctagccatgctgctccaaaggtactgtaaggtcaggggatacgggacaggaggcacttcgctgaaccctaatgccctctgcaactttcccatcaaatacccttgtcttctgaactgtctgtattttcctcatatgcaggagattcttgacattcctgcttgacctgttaggtagcctgaactagggaaacccctgtgccctcctcttcttacattgtggaaaaggattggctgcaaaaatgtatggcctgcatgagaactaggtaaagagaaaataacttaagcagttgaaaccaacatctcagcttagccctcctgagaaagatagcgggaaatgcatatcacaggcagtgctcaagattgcaatgaagctatgggaaaacaccctggattatcaccaagatgaaggcacacagtgcattgcatcgatgaggatacaaaagcatcagcaaaagcaacagcagtaacttttcagaagtcctccacattatagtattatattacaatataatagggtgaatggcctcgtacgtctgtagccatttttcaaaggcctaaagcaataaacagaagaaggctgaggcacaacgccttcaccagcagacaagcccaccagtcaccggaaaaagggaaaataagaatctgtccccatcatccatttctgatgtttgccactggaccatgtatgttcatgtcacatcggtcgatatgcattgttgtcctgtgtcctccagccatgttgctccaaaggtactgtcagggaagaggaaaagggacaggaggcacttcgctgaaccctaatgcccactgtaactatcacatcaaagtccctagtcctctaaactgtctgtattttcctcatatgcaggagattcttgacatgtctgcttgacctgttaggtagcctgaagcagggaaaccctctgccctcccctgctcaaattgtggaaaaggattgacagcaaaaatgtttggcctgcatgagaactaagtaaagagaaaataacttaagcagttgaaaccagcatctcagctcagccctcctgagaatgatagcgggaaatgcgtatcacaggcagtgctcaagacttgaaataaagctattggagaacaccctggattatgaccaagatgagggcatacagtgcatcccattcgtgtggatacaacagcatcagcaaaagcaacagtagtaactttgcagaagttctccacattatagtactatgtaacagtataattgagtgaagggtcacctacctctgtggccattttttacaggcctaaagtaatacacagaagaaggctgaggcagcaatgccttcaccaacagacaagtccaccacacactgggaaaatggaaaataacctgtccccatcattcatgcctgacgtttgccagtgggccatgtatgctcgtatgacatctgtggatgtgcaatgttgtcctgtgtcctccagtcatggtactccaaatgtactgtgagggaagggaaaaagggaattgggggcacttccctgaaccctagtgcccactgcaactttcatatcaaagtccctagtccttgaactgtctgtgttttcctcatatgcagcagattcttgacattcctgcttgacctgttaggtagcctgaagtagagaaacttctgtgccctcttcttttctaattgtggaaaaggattggcggcaaaaatgtatgacctgcatgagcactaggtaaagagaaaataacttaagcagttgaaacgagcatctcagctcagccctcttgagtaagataacgggaaatgcgtatcacaggtagtgctcacgacttgcaataaacctatgggagaacactctggattatgaccaagatgagtgcctacagtgtatggcatcagtgaggatacaacagcatcagcaaaagtgacagcagtaactttgcagaagtccatcacattattgaactacgtgaccatatagaagcccatcattcactgaggatatggaaaataatgacctgtccctttcatcaatgtctcaactttgcaatgggccatatatgctcataggacatttatcgatgtgcattgttttcctctgtcatattctggagattccttgcattcctgcttgaattcttaggtagcctgaaatacggaaagcagtgtgccctcccctcctcaaactgtggcttccccttatcctgtaacagctgcagtagctggagtactatacaagatgtataaatccctcacggttgtgtctgtaacactctctgcttgaaagcacaggcaaggtcattttgagaccatgtaatttcccctctgagaggaccaaatggcagatgggtcagatcaccaagtggcaacagcttataaacagggaaactgacacctacagccttgaggtaggtgccattttcagcatgaggaataggagagattaagctgctagcctggatacctgacatgggagcttcctgaacactcaggctcttctacagatacctatgaggatcaaaatttcaccagcttcatgtactggtcattgacaggaaccacatgacttttctgtccccaccaatgtgcagagtatgatcaatggaagagtgcaagaagctaaaacagagaaatgcttgaataaacttcaactgcgttcctattcactgaatcaggggtcctcatgatgcctgacatgccattcctcttcacagtggaaaccatgcagttcagcacattagtgtctgagcacagaatcctgacagaaggccatcaccagtttcttc

SEQ ID NO: 1832 - DNA, 1850 bp, artificial
  synthetic oligo
ctggctctagatcactcttctttaactcgtttgcatataaaaactacacacatcatgttttctgcgggagaacacctggaaatgaggcccaaagccaaatttaaagaaaaacagtatattaaatacacaattatggttttaaaataaaactgtgcaacgtgacctgcaaatgtcattcattccagaaaactgaacgcattcaatctgaccatgaatttactcatttttaaattgaatattccctataaatttcaagggaaacttatgcaaaatactaggaacagaattggactgaataacgtgattttcgacacgcaattcacttgagatataagattacaaacaacgttcaatcatgatcggtgaccaacacttcaggcattcactgtcgtaaaacaagtgctgggtctgttctcactcataggtgggaattgaacaatgagaacacatggacacaggaaggggaacatcacacactggggcctgttgtggggtggggggagtggggagggaaagcattaggagatatatacacccaatgtaaatgacgagttaatgggtgcagcacaccaacatggcacatgtatatatatgtaacaaacctgcatgttgtgcacatgtaccctaaaacttaaagtataatttaaaaaacaaacaaacaaaagaacaataacaacaaaaaaacaagtgctgggtcaatatatgtggttttacattgaatatactacaaaacttccttcatttttggtatatctatgaaataagctacacaaagactaaaacttcaccaaatacaatggtattaaagcaatttaatggtaaaataaaatcaaagttcaggctacctggtaacttgaggccagaactgttgtaaagcaggaggcacaaagccaattaaaacatttcccttattgtgcatggaaaataacaaaaaatttttttacccaagcttatgaaatgtaccaggatcacatgtaattgaataaaatgataccaaatacccaattcttctgcaaaataaaaccccctggtcatcaaccaggtttgtatctaaattaatgatctcatttctgcatttccccccactacctacataatcaagaatttataaatgcttttgaaaagcacctatataattctgttggttccctgaatcatgggttgagtaaaattttacagctgttcaccaataatctgtgtgggatttatggtttgtaacaatttgggaattgtgttttcaaaccactttctggaaatgaggatacattttccaagagcctgctggctgacttctcacatagtgttgaccaaaatgaggtaacgattcatttactaagaggcttgggataatcctaactggtttagaggattcaacatctgggacagaaggatcaccagtggggacactatcccccaggttaccacaggactctatcttagatgttttataatgcaggagtcaacatcagtcactgaatggcaggggatatcgcttctgaacaagatatggaccacatttacaggaccagggagggaaaggtgccatattcattcagactctatttctttctcaatagtgtctgacatttattgaaaatatggaaaatacttttctccaggtagtataaaggagttaagcagaagatacaagttattttgttgatcaaaaagcacctgagaaaatgctgcaaattcagaagagaaatggattctgggcaaaactaactggtccacaagagaaaatgagagactcgatttggctgccaggcacaactgagccctggcagccatgtggcaggagcacaaaaagtctctgggattggggaggaaatgggtctcgctgaaggtaa

SEQ ID NO: 1833 - DNA, 2250 bp, artificial
  synthetic oligo
gcgacccggccgggggcgggcggggacactgtcgcccctccagccgggcctccgcggccgccgccgccgccggcgctcactcgatccgcacttgcaggcggacgttgagcatcaccgaggccacgatgtagaagtaggggaagttcatgcgcagccgccaggccaggtcgaagaaggtgagcagcgtgcgcgtgagccccttgcagaaggcgccgtatgagcctcgggccgccgccgagcgcgacagccgaaccgccaagccagacagggctgccgccgccgccgccgcagacagagccgccgacgccgccatgggcccgggccccgcgcaggccccgccgaccgatcgacccgcaagagctcgagcctcaggacggcgggaccccaacactagcgcgccccgccggccgccgggagagcgacgtccgccccgccctcgccccaccctcgccccgccctctccccaccctcgccccgccctcgggttctccagactgagccttgcttcaggggccactgcctcggtccctcctccacgagcccgcacagctccatccgctccacatcacgtcactgcgggccccgccccccagcatagctccgcccctaacagcctcgcccccggcagagaggccgtcggcgtagcggccccgcccactagacccgccctgcattctcagctccgcccaccgcccggttccgcccacaaagccctgcctcttttcgggcgcctcccaaggcaggagcggattgaagggcggagctgccagggatcgattgctgtgacactgtctcctagggtggagcaggagtggaggaggacagtctggaccgctaagctgattctgtacagaaagcacatgcagaagactctgcctgttcatatcactccccttctcccacggtctcccctgaaaacttgccagccaagacctttctttaattcgcatttctctttaatgcgcatagtgcagtaattctgcgctaaagagtgccaccaaacccacaagcgtgcatttttccctttctgttgtatttgctggtcacgtatatctctgtgttggcgaatttccccgttgtccttccctttctcagcagtcttcttgatccatacaatgttgtctcgggttttcatttgctcttatttatggcctttttttttttttgccggtgtgcttaaaagcccttttgtggtttcattcaatctttattaaatgtaaaccaatcaaaacccagtagcgttttttcggactgtttaataaagccgggaaatactcacactttgttatggtcatgacttttgaaaaactgtccgcaagaagaaggttcacccgaccccatcccagttttcacagcaaagattgacgtgggtatttaagaactctcaaaatacctgttcgccgtcacacttgatcatctctatggtatcccacgtaactgtttaaggaacgtagtagattcatatacactgattaggcaattgtcctacctacatgatcatgtaaaaaaagacaaaactgagcatcaaggaaactgaaggaaatggtgtggtgcagggctgattggtagtccacttttccacctgctgccaaacacaattaaataattttttagagaaagggtctcactctgttgcccaggctgcagtgcagtggtttagtcatagctcatggcagccttgaacttctgggctcaggcgatcctcctgcctcaggctctggagtagctaggacaatagatggggctacaaattctatatccatgaatacatcttttaaggatgaaatggaaataaagatattttcagataaaagaagattaagagaatttgtgagtaacagacctatgcttaaagaatggcagaaagaagttccctaaacagaaataacagaaagatgatggcatttcaggaaggaaaaagaacaattggaaagagtaaatataggggtagatataatagaccatcctcctcatgagtttttaaaatgatgtttgatggttgaagcagaaactattatgtcatctgatgtgatgcttaatatatagagaggaaatacttaaaacatttgtattaaaagtgaggcaggtaaataaacctaaatggaagtaagatttctacaacttactggaagtggtttaaaatatccatggtagtagaatgtgataagttaatatgtatattgtaattcctattgatatggtttggctctgtgtccccacccaaatctcatcttgaattgtaatccctat

SEQ ID NO: 1834 - DNA, 1300 bp, artificial
  synthetic oligo
tttcagattatatttaaagagactgaatatatgagaatgtgagcggcaccagtgggctttgaggcaatagtcctagcctgctgtgaagaagtaaactacatggggatcattttaggccgatagacagggtgcatttctggctcatttatagaacatgacgcttgtgattatatgtggcccactcccataatgtgggataatctcctcatgtcacgatctttaacttaatcatatttgaaactttcttttttcgtgtaaggtaacatattcacaggttatggggattgtgaagtagacatcactgggggatcactgcttacctaccacacgcgagtcagcttgcacacacatgatttcttgctctgtcagctgagagagccaagaagcaatgacacccaagtagtaaagagcacacctagagcccaaaccttggtttctaatgtcatccaacaataaaaggagccagggctctttggctaaacgactgattccaaggctgagcctgggattgtgcaatatgagcctggagaatcttgtaataccagtaagcacacacacaaacacacacacaatgatgggagtatggcaaagagacacaggagcctgctaaaagtgctcccaatggctaaagctggagcaagctgggcaacagaacagatacagtgcttttggattataacttaaaatacaaaataaatatccatgagtccatactgatataaataaatagggcgaagagacaaatctcctttgcagaataattccaatttttcgcagatattttacccaagataaggtagaaaagaactctcccctccttcagcatatgctgtgcgcagtaacctccttccaaagagtagaatgtggaaaggcagaaaaacatacctttactgctgagaaacctgatccatacgacctcagccaggtgaccaaggttgaacttaactgtcatgtcatgtggattgtatgctctcttgatagggggtgatgagaatggcacttaactttcttggtcttcctctcgaaaacccgtaaccccagtgtcatcatgagaaaatcacctggcaaatcccggtcgaaagacattctgcaaaatacctggccagtagtcatcaaagctgtcaagagtcatcagaaacaagggaagtctgagaaactatcacaaccaagagcaccctaagacggcatgattattttaaatataatgtagcatcctgtatgtgaggctgaaacagaaaaaggacatttgattaaaatggaggaagtctgaataaagtgaggactttgggtcataataatg

SEQ ID NO: 1835 - DNA, 4850 bp, artificial
  synthetic oligo
gaaaccaacgcttgctagacctccgagaagtcctgtctgaacatgcaaactaaacaactggatgggagaaaggaatccagcaacatccgcaaacccaactgttaacaaccaagaagtgggggctgagtgagcttagtgtaaatgcaaaagagagccagagggatgagctctggatgcattctacttcacatctgttacagaggactggaggacaagaagtagagggctggcccgggtttaagggtgagctttgtttatatatggcagtattcagcccatatgaccgggctagaaatgagaaagtgttgcaagaagaaagcccgtgcagtttcctggaggtgcccatgactgtttctgctcgggatggcctgtgtgctgcaggggcaagcggacaaagtgtaatgtctctcctcccttacctgatgctgagccgcctgggggctgattcccctgtgtattccttactttcctggattttagcctggacaacatacctggcacactatggaaccatccctgcagactccggggtggggggtgggggtaaggggggtggtcaaggttgcaaaaaccttagagggacccctacaggtcctctctatgttcaggagggaagacaagtaagggattctggaggagactgttgtcagcctgatttagagaggcttggtctttcctaggttttcaatttaacctcccttttctattgctaccttcatacctaggcaactgttaagcattactccgtaacagagaacatctctatagcaaaatcactctatgacaaaagattacaaattgctctatgacagcaaattcttaagaaggaatggagagtacaaaaatgcaggcattcagaatggggagcaaggccatctactctgtgtcctgatgaaacaaaagcaattgtgagtccccagactgcatgctacaagtgcgctctacaaatcaaatcctgattttcttatggtctttaggatataatccttcaagaacatctaagtaaacttcaaaggagaaatggaaagaaccccaactattaatcaaagtgcaatataacaaaaaattgaccggtacatgtccacattgtccagttcttgaggcaaggaggaaatgaaatcgaaactgaaaagagaaacgtgcaaaatcagaagtaagaacattgtctataacttatggaatgtgaccaaagctagacttaaagtacaagtcatagccttaaatgcacttatcgtttcaaacaacatagaaggagagtacaataggctgatatttttggaaagctcactgtgaatagcacctgcacaccaatatttcatcttcctgctatgtatgtgttggccagtgtttcctgtccctcgtagtgcttatgagttgccattatttcttcgaaatagtccatacttcaaaggtggactgtgttgaaggctcaaagcatgcacaaacagaacactgtggttgtattgaagaaagggatcctggcacgtgctgggggcaggagtcaagagagatacttttcgccaccgttcagggaagcatctccaacctcaattgctcagacaatgtggtaatgagactgaaataggaagagcatatgcctgtccacttgattaaaatattgcatagataaagatcagtcgggcacctcatgcttcctgctgtatggtcctgagttctgaaaggaatgccactgcttacatactccttacccctatgatgtggttggcttgggacaaagacatttttatcgaaatgatgaagcaagatctgcctaggcagaaaaatatgcaatgtagggcagtggcaagggtaggtgaacatttaatagcaaaatgcaaagctattctcttaaatgaggtagacgaaaactctacttccaagacagcctaccgcaagcaaaggcctttatgagtaactgttcatttctgtaggacctgtttccctcaagatatgcttagagaactctctaaagtgtgcagcttggtgcatcatatggtctgctctctttatgaagcttttagagcagtgcctacatttgtatggcttctcccacgtatagattcttaagcgaataacaagacttgatctctgtctgtagcttgtcccgcaagtatcacatataaatggtatcccctcagcgtgtgttctcgggtgcaaaaaagagctgtcgactgactaaagctttccccacaactgtgacaaccttgagatttttcacctgtgaaagcattcgggtgtcctgtcagacttgatctaggagaaacacctttcctgcactcaaggcactcatacatttccttatcacaacgtcttcacaggtgctgtgaggtgcgacttattattcgcttgttatgcactgtgcattcacaggggtctcccacacgtgaactggctggtgccgataacggttggacctatgagggaatcctttcccgcattcagggcacttgtgaggcagctctcctgaatgaatgttgaagtgcctagaaagtagcttctctcaagcaaaacattgtctgcactgagaactgcaggattcaaagggcgtgattcagttacctgaccccaagagaggtgggcaagtgttcactgaacgcctgggaagaaagaaaagaaaaatgcagccttaatcacggtaaagaggtttaggatgttgcttgggagcttctacctttccactaggcatcgaagatggctcttcttcttctccatctctctgttctccttggagcggggtgacatctgcaattcctatctcttctctcgggtttgatattggcaaagaaaatgaagaaaaaatgtcagagcagaaaaaaaaaaaaaaaactggagagcgtgtattcattttttgtttctttagacaggaatgcacttcatggtcgcaatttacaaaaagactgtgaatggcccgggcatcaccccgcgctccccaagccccgaagagcagctactgggtgacacgacgtctgtggactgtcagagtccctgtgtagcagagacagcggagagctcaaacccagaggtgcctctcaagcccagaacccacaagcaagagtcccgcagagaaacctcctcattgttctcagagttcaattgttttaatttttagctcccacagatgagtgagaagatgcaaaatgtgtcaaaatgtgtcttcctgtgccaagcttatttcccttaacataatgtcctccagtttctatttattcctgattctctgttggtagcttatacgtatctaggaattgtcccattatttctaggtcttccaattcgttggcatataatttttgatagtaatcttttatgatcctttgtatttctgtggtaccaattgtaatgtctcctcttttatttctggttttctttatgttgtcttctttctgtttttcttagttagtgtagctaacaaagacgaatttgtttatcttttaaaaaatccaactcttgatttcattgcattttttctattgcttttatagtctctttttcatttatttttgctctgatttttgttatgttctcgcttgtgctaatttgttcttagtgtgtttgtctttctctagttccttgaggtgtaatgttagcttttttatttaagatatttttgctctctcgatacaggcatttgctgctatgaatttctcacttggaaaggcttttacttcatcccatacgttttggtatgttgtattaccattgttgtttgtgtcaaggtactctttatctcacttttgagttcctctttggcccatttgttgttcagtggctcgtgcgtcaatttccacatatttatgaatttcctgattgccccaattattggtttctagattcatatcattgtgatcagaaaacatacttgatatgacttcagtcctcacaatcaattgttttgacgtgtcttgtggccaaacataggaccaatctatcctggagaacgttctgtgtgcactggagaaaaacgtgtatttctgttactctccgatggaatgttctgtagaagtctgttaggtccatttggtctaaggtgtagtttaagttcaatgttccttttgtctggatgatctttccattattgaaagtgggtgttaaactcccctactattattgtattgtggttcatctttcccttcagatctactaatatttcctttatgcatgttggtggtctcgtattggctgtacttatacttacaattgttaaatcatcttgagtaatggatgtccgtattattatagagtgactttatttgtctcctttgctctcttttgacttacaggtatttcatctgatatgggtaaagatacccttgctctctttttggtttctgttttcatagaatatatttctcaatcccttcactttcagtctatgtgcttctttcatgtgacgtgagtctcttgtaggaggatagagtttggtaagactgaaagcttttcccctgagatcaggaacaagataaggatgccagctttaccacgtctattcagtattgcactggacatttgagccaaatcaatatagaaaaaaaagaaaacaaagaaggagtttttgaagcggaaagttaaaagccatctctattaaaaaatgacatgatattaaatatgcaaaatatagagagaatgtcatgagaggtaataaagttttggtctctgtggggccttgtagggccctgaaagtgtttcggacgttactgtacgtgacatttgaaatccctgaaaggtttggagctttccagtgatccctcgggccgtgtggttatgaacaggctggaaggagccaaaacatgaagcagggtgaccagttaggatgggtcttctgtaattccttggcactgtgactgtaatct

SEQ ID NO: 1836 - DNA, 6100 bp, artificial
  synthetic oligo
agacaaaaacatgaaatttcatgggatgtacttgttggattttattataacccttcccagcgggtaagcagcttgtccttccttcaaaagctctgtgtttgtatgtttcttcatgactgcacatgagctgcacccccgcaacaaagtggctcatggaggcccatttacagcagagtctgctttctatggttgttggtgttgttaaaaaaatcaacagaggtcttagtgcattgctcaacaattttattcctaaggaaccagtgatgaatgaaccacagctaaatatcattgctggcccaatcattcagtcattgaacttaataacattttatctgctcagtgagtctgtcacgccttcctctaagtgctggtgatgctttaatgaaagaaaaaaaaaagaaagaaaaacaaaaccgaccaaaagacatcctgccattgtggagtttacattctagcatggagaagaaggaacataaggaataataaacattgcaaattatgtgaatgacagaagatgaaagaggctatggaacaatacaggttgtacagacagcataagggggactcaaagctgaagtgtaactttaaatcatgcctttaacatgctgtccctgatgccttttctgttaaatactttggctctgatgttccctttagggccgtcctaggcctctgtcatcctggaatctgctgctgctaataggaaatatggaattcaaatttaatggcagtgttcattttaattaagaactcctttcctccagtgactactagcaagctaatttagcatgcttttaattgataaggcacttccctaagctgggttcatggtccaattgaactagccagtatctcaattagatttgccagaaaagtcatatgtaaaatagtatttaggcttactaagctaaccttttcagttaaaccagcccctttactgctcttaaaaggaaatataaacagaataaaaatgttttgtcatgatttttgtactggggtgatagaaaccgctctccacttaaagcagaactgaatgctctccaccatgaccacattgacgatatcatctacttgaggtacgtatccatcaggaagtttcacagaatccaaggtgaaaaagatagtattctttatcaccccacttcttccacgtatgtgagtaatgcggacctgtgagtataaataatggaaatgattatgagaaagcccgataatcactgtaaccagctttgcacctcctcactctgggtcctgcatgagtgcaggtcacttcaatgcaaatcattgatttccaacctggttggcccattgctaacaccaggggtgctttgtaagaatacccatgtccacactccaccacagaccaattaaaacaggctctccagggatgaggcatgggtctttgatgagaaatccagctctaaatattaccaaaatatgtccattaccctctattgccctgaatttgctggtcatgttcaggctccaatacccaaatcattctcaacatttactgttaagctcaagtcccacaacgcactccgttcattctttccctacaattttctgacacaaagattgtttttcttcctcctgttgttggaagattctaataaaatttgggtattgagtaaaatgcacaatttagaacttaatcgattaatatgcttgttctacataattttctaattatttcctttgggaagtcctgccttttcagtaagaaaagtggctcctttgttggcaaagaatgtatttcttcatattttctggaattcccattacacccaacagaatcctgggcacgaaaattatcacgaaaggaagggttcacagaaaccgatgatgggagcaacaggaaagaaattaccgcttccgcatgaatacaacgagtgggcttcacagagcttgccttgaagtttaagaagcctggttcagtggaatattcaacttttaaccagttgcccttataaggcacaaaatctaaaacagccatggagaaatgtgagtgtcatgatctcttaactaggtcatcttgaattgcacacgttatttgatagtgtactactttaaagtcagttctgcaacacctaaagtcatttttgcacatatttaaacagacacactgtaaatcggtaagttcaagaagaagtttataatccttaggcattgactctcctctactgatttaacaaagtcaaatggagcaaagtgtgaactgtgcatcacagccaatctgagggaacagcacaggatttactaaacaactgttcgtgttcacaactccttagtgagaggcagtcaaacatgtaggtaagagcacaagtttgaacctggccatgtgcatttgaatcttgacactgccactcactcagtttgtaaccttagccaagatgtttaatctctctgtgcctcgttttcttcatttataaaatgagaagcacgataagtagccttcaagatactgagctgctgtgacacttaatagatatcgttgatacacacagaatcatcactggtgcatagtaaccaccaaataactgttgattggtagtagtggtagcagtaccactaggaaatgttgttactttcagaatgaatcaatttcccctagtgttgtgttccgctgatgaactctttttattattattattattattattattattattattatactttaagttctagggtacatgtgcacaacgtgcaggtttgttacatatgtgtacatgtgccatgttgatgtgctgcacccattaactcgtcatttacattgggtatatctcctaatgctttccctccccactccccccaccccacaacaggcccgggtgtgtgatgttccccttactgtgtccaagtgttctcattgttcaattcccacctatgagtgagaacatgcggtgtcttaagtctgtgccttaagggttaccgttaagaccatcgaggttgaaacagaagtttacgataagttaaaagtgactcacaggataacaaatgtacgtgaaagaatctggagcaaatggaaatcccaactgcaactgagaccgtaaattgccacagtgactccagaaaactagcaatatcaacaaagtgaaatatttattcaccttaggacccagcattgtagactgatacaagacacagtgttagacttctgtctctctgtctgtctctgttaatttgcatacatttcttttgtgtgcgtttactgtatatctatgggccaataactccaaaatgtatatgcctccagctctaaccaacctcagggtcaattatccatatgcttacaccaatctaatgtgtgcaaagctgagttgttggtattcttcatattcaccaacttttgtttgcctcagtcgtctgcatcacaaactggcaactccactctcaccactgctcaaaccaaaaactttggaggtaccttggactcatctttcctccacatcaaagatctaatccattacctcctgggttcttctctaacttcaaaatatatccagagtcaactcaatcctcaggtcctccacttctccactttcattcacatctccatcatctctcaccaggaatattacaacggtttcctgaccaatttcctgactccacccttccctcatagtctcttctcgacaaagcagatagagtcaacatctgaaaacaaaattcaggtcagggtcctgtttttgcatccaaggaaacaaactagcaagctgcctggggaagtggagctaatctcccctttcatacccaagctatatgactgttgcaatggacaaaaatagcaaaaaaaaaaagtgtatctttggttataagcgaaatattagaacatatcggctgattacaaacagaattccacaacacacacacacacacacacacacacacacacacacagccacaaagcactatctccaatcctaactttgaagatttgaagtgcattcttttaaaatttggtactgtgccctgtcacagaaacttctctagtaaccaactacagaaatgatccctgcaagtatagtctttgaagggtattaaaaatagtgtctctgtgtacttgtaggattgtttccatgattagaaactaaattcttatgtgaatgaaaaatatatccaggcattactgagggcattgaacaaatgaacgcacaatagacgacagcagacattttaaaatacttcctatttgcccctatattgtacataatttcaattggaaaggtctacctgtaatattgaagagccattggctgaagccaagtacactgtaaaatttgttctaggactaaaatccactcaaaaaattaagaattacatcatatatcacaaaatgtaagtcataccttcagaaacaatgtccatagggaaataaatgatgttactaatataaacagtatcttcacttatagaagtaacacatccatttaaaactctgatttttgagtctgagggtccatcatcgttaagagggtgaggcacaacatccacctgtaagatttaggaaagagttacttcaaaaataatacaaatttaaacacaggaacttacatggttaaaacactggtattccaaaatattttcaaaaaccatccttaacactggtgaatatagttcacgtgctaaatggaccatagacttgagatgatggtagaaatcatgtgtgtgcttcatgaattgtgaaatgtatcccaaaacattaattgcatacccaagtttaatgcccttgtaccattagattcccagatttaaaaaataccgtcattcacctaaaggaattcacagtgaaatgacggtaaaatggaaagatatgtagtcttagcaggttgtgatgaatgatataagactagtttaaagatagtttctgtgacttacctaaacggagaacatttcagacagggagaaaatagcggcattgcttgggggaagtcagatttgtgctgggttgtgaaagaaggcagaggtgtaaacttgtaaacacgagtagaggagcaggaaggcagagaggaaaaacaacacaatttagaagcctagggagcaaaaccctaacattccagatccaggtctaggagacagaagttcaagttaaagttggaacaataacctcaactgggggaggttcaataaaccaagtcaaattagggctttactttatctacaatagagaggcatacaaacctttttccttattggaagtgtaatagtccttattttataatccttaaaacttacagaaataatgcaagttcattgtactaaaagtaggggaaaaaaaaaacagatatgcagacagcaaaaggcggttacaccataatccatattccattaccaagagaccaccagggactacattttctcagtaacactcatcctgatgtttttgtctgtgcacaaatatatatacatatgtaaatactcattttaaaagcaaattagcatggtattcagtagtaaagtatcacattaaatgaacacaaagtttttcaaataacaagagaggacagaaacactcatagagaatcccaattaatggatgtgccgtaatttactaacccaattccacgtaattagacatttcgcttttgtcttaaaatttgtactacttgcttgacttaactataggataaactcctagggttggaatttgcagatcaaagacttctgatggaaacttgagccactgagttgtaaataatttttcatggttttaaaaatagcctagtttgctgctattctcatttcttaactggtgtctttccagctgtcaataccaatctgatgtttattttcccctcacttactgtcatgaaggaatgaggcattagcctcccatccatgtgtctaccaccacttccgtcagtatcccagtggatgatccacagcaccctcggacctctctgttccttgactccacgccaactcacagacatatgcagactaaagctttgcccatgtttcatggctcccaactctgtttcttatgccttggaaataccaccaacacaacagcaggtacggacagattgaaatgtttgcaataatgcgttgtatgacagaagtggcatttcaatacgataggggcaaagtggattat

SEQ ID NO: 1837 - DNA, 1700 bp, artificial
  synthetic oligo
agaaaattcaaataaataaaagcaaagttgaaaaaggagaaaccaaaactgacatcaccaaaataaaacgcatcataagaactattatgaacaatcatctacctacaacaggacaagctagaagaaatggatacattcctggacacatgcaacctaccaagatgtaatgatgaagaaatggaaattctgaacagaccattaacaagtaaggaaagtgattcagtaataaaaaatctcccatcgatgaagagtctaagacagaatggcttcccttcgtaatactaccaaaatttatatataaagaagaagaattaatagttatacttttaatgctattccaaaaaaatgataagaaaggaacgcttccaaatgcattctatcacacccgcgttaccctggtagaaaacccagactaggaaacacaaaaaagaaaaaagcaaagaaaactacatgccaaaattcctgatgaacacagttgcaaaaatctttaagaaggtgttagtaaaccaaattccacagcacattaaaaacaccattcatcatgttccagaggtattcattcctgggatacaaaaaagtttcaacatacacaaatcaataaatgtgctatatcacatgaacagaatgaagcacaaaagccataggatcattccaatttaagcaggaaaagcatttaaccgaattccatatcccttcgtgataaaaactccacaacttagatataggaggagtgcacctcaacacaatataggtcatatatgataaacccacaggtaacatcatactgaatggggaaatgttgcagtcttttttcctctaagacctaaaacaagacagaaatgcccacttttgccctttctatcgcacatagttctggaagtactagtcagagaaactaggcaagaagaaacaaaaggcatctaaattcaaaaggaagaatttagattggccctgtttgaagacgggaagctcttacttataaataaccctgaagacaccatgaaaaacctacaaggtctaataaacaaattcaggaaagtggcaagatacacaaccaacacacaggaatcagtagcatttctatacaccaatagggaactatctgaaaaagatatcaagaaacaatcccatttaaaacaccttcaaaaaataaataggaataaatttaacgaaggaggtgaaggattgcaacgccgaaaactataaaccattaatgaagcaaattgaaggaggcaggaacgaattgaagtgtatcatgtgttcgtggacaggaagaataaatattgttaaaatgtccgtaacctaaagcaatctatagattcaatgcaactgctatgaaaataccaatgacattcttcttggaaataaaagaaacactcctaaaatgtgtatggaaccgcaaaagattccaggtagtcgaagcagtctggaatacaaagaacaaagctggaggcatcacactacttgatgtcaaagcatatgacaaagctatagtaagcataacagcatagtaccagtgggtacatccacgaatggagcagaatacagagcccggaatgaaattcgtgcatttacagtcaactgatattcaacaaaaggcccgaaaacacacaatgttgagaaagtacactctcttcaataaatgatgttgaaaataactagatattcatctgagtaaaatgagtttccacccttatctc

SEQ ID NO: 1838 - DNA, 1600 bp, artificial
  synthetic oligo
cgattcgcttctttcctcttgctgctttcaggatcctctcattctctttcaactttgacagtttgatgttaatatgtcgtggggtaatcttatttggattgcatctgaatgcagaactttggtcgtccagtacccagatgtttgtaactttctgtgggtttagttggctctccattattattttttaaataatctttctaccactttttcaatctctcctccctcttgaatgtgagagattcatactattgctctgctgataattgtcccagaaattcagtaagtttttattttcatttcgtgtccttcctttttcttttgtctcctctgactgtatattttcaatgaagctgtctccaagtttacagattctttcttttgctcaatcaattgtcctctggatgttctctattgtgtatttccttcattgtgttttttgatttcaggatttgtttggatttttaaattccttcaatctttctctcaaattcctctgttaaattctgaatcatttctctgtaattgttttcaaggttcacagagcatgctgaaaatagatattttgaattatttattaaacaactcatacattcctatctctctagggtcaattactggcaccttgttttgtcagtttggtgatgtcatgttttccttattgttcttcatctttgtgatcatgtgtttatatctgggtattgatgaagtaggtattcattttagtctttacagtctagcttttgggggacatcctttggcactaagcctgtccagaaactctatataggtctcttttggtccttatgcttgtgaacgctacagctattgaagcactagggagcttcctaatcacagggacacagcaacagatgccgcaatggcatgcaatcccttagctattgaggctggtgccttgcgagactggaatccaaggctccactcattcactgaggactcactgttgctgtagattattctgagcataagtccactggaataactcagcagagacttgggccagatattgggtttgttttgctatggctgcagcttcctgtcgggtgccaggatgagtctagagactctgtccacaagtaccattttggagtcaggggccatgggcgtctgtcaagtgatggcgtatatgtgtgacaggcctgatattaggttcccaggcaatgtcctatgcttgctactctctctctcctccgggtggatggtatctctctccatgctgtgctgttgaaggttggggaaggggtggtatgggtaatgtaaaactgtctttactaccctcttcaatgcatcttttcttattttcatgctataactgggtaccgtggtctctcacctggtttccttctctgaagtgatggtattttcatacaaggatagtttttcacattgatgtttctacaggaggacaatcactggagagtcccatttctccatcttgctcccctcctcctccatctgtttaatttttacctactataaatatgtccatcttgtccatgtgacttctgggctcaggaagtttccttaggctaattctaacacacaatttacactagtattcacttagcttttcttctgaaag

SEQ ID NO: 1839 - DNA, 6000 bp, artificial
  synthetic oligo
tcttacaggtggatgttgtgcctcgccatctttatggtgctggaccctcagactcaggaaccagagttttaattggatgtgttacttctatatgtgaagacattatttatattagtaactgcatttatttcttcatagacattgtttctgaaggtacgatttacattttgagatatatgatgtaattcttaattttttgagaggattttaatcctagaacaactcttacagtgtacttggcttcagtcaatggctcttcaatgttagaggtagacctttccagttgaaaatatgtacaatataggggcaaataggcagtattataaaatgtctgctgtcgtctattgtgtgttcatttgttcaatgccctcagtaatgcctggatatatttttcattcacataagaatttaatttctaatcatggaaacaatcctacaagtacacagagacactatttttaatacccttcaaagactatacttgcagggatcatttctgtagttggttactagagaagtttcttgtctgtagttggttattagagatatgtacctaattttaaaagatctgtacctaattttaaaatacacttcaaatgcttcacatgtgagattggagatagcgccttttggctctgtgtgtgtgtgtgtgtgtgtgtgtgttgttgaattctctttgtaatcagcagatgtgatctaatatttagcttatacccaaagatacacttttttgtgttatttttgtctattgcagctgccatatagcttgggtaaaaaaggggagattagctccgcttccccaggcagcttactagtttgttttcttgggtgcaaaagcaggattctgacctgaattttgtttaaagatgttgactctgctttgtcgagaagggactatgaggggaagggtggagtcaggaaaacgttgtaatattcctggtgagagatgatggagatgtgaatgaaaatggagaagtggagaacctgaggattgagttgactctggatatattttgaagttagagaagaacccaggaggtaatggattagatctttgatgtggagaaaagatgagtccaaggtacctccaaagtttttggtttgagcagtggtgagggtggagttgccagttgtgatatagacgactgaggcaaacaaaagttggtgaatacggagaataccaacaactcagctttacacacgttagattggtgtaagcatatggataattgaccctgaggttggttagagctggaggcatatacattttggagttattggcccatagatatacagtaaacccacacaaaagaaatgtatgtaaattaacagagacagagacagagagagagagaaagagagaagagttctaaccctgtgtcttgtatcagtctacaatgctgggtcctaaggtgaataaatgtttcactttgttgatattgctagttttctggagtcattgtggcaacttagtgtctcagttgcagttgggatttccatttgctccacattctttcatgtacctttgttatcctgtgactcacttttaacttactgtaaacttctgtttgaaactcagtggtcttaactgtaacctgtaaggcacatacttaagagttcatcagcggaacacaacaccaggggaaattgattcattctgaaagtaacaacatttcctagtggtactgctaccactactaccaatcaacagatattttgtggttgctatgcgccagcgatgattctgtgcgtatcgcacatatcaactaattctcacagcagctgtgtatcatgaaggcgacttatcgtgcttctcattttatagatgaagaaaacgaggcacagagaagttaagcaccttggctaaggttgcaaactgagtgagtggcagtgtcaagattcgaacgcacatggccaggttcaaacttgtgctcttacctacacgtttgactgcctctcactaaggagttggaacacaaacagttgtttagtaaaacatgtgctgctccatcagattggctgtgatgcactgttcacactttgctccatttaaatttgttaaatcagtagaggagaatcaatgcctaaggattaaaactttttgaacttagagatttacagtgtgtctgtttaaatatgcacaaaatggactttagatttagcagaactgactttaaagtagtacactatcaaataacatgtgaaattaaacctgacctagttaagagatcatgacactcacatttctccatggctgttttagattttgtgccttataaaggtaactggttaaaagttgaatattccactgaaccaggcttctcaaacttcaaggcaagctctgtgaagtccacccattgcattcatgcggaagcggtaattactttcctgttgctcccaccataagtttctgcgaacccttcctttggtggtaactttcgtgcccaggattctgttgggtgtaatgggaattccagaaaatatgaagaaatacattctttgccaacaaaggagccacttttcttattgaaaaggcagaattttccaaaggaaataattagaaaattatatagaacaagcacatgattaagttctaaattgtgcattttactcgatacccaaatgttattagaatcttccaaggacaggaggaagaaaaacaatctttgtgccagaaaactatagggaaagaatgaacggagtgtgttgtgggacttgagctgaccagtagatgctaagaatgatttggttattaaagcctgaatatgcacaggcaattcaaggcaacagagggtaatggacatattttggtaatatttagagcaggatttctcatcagagacccaggcctcattcccagagagtctgatttaattggtctgaggtggagcgtggacatgggtatccttacaaagcacccctggtgttagcaatgggccaaccaggttggaaatcaatgatttgcatcgaagtgacctgcactcatgcaggacccagggtgaggaggtgcaaagctggttacagtgcttattgggcttttccataatcatttccattatttatactcacaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcctaaatagtattttatatatgacttttctggcaaatctaattgagacactggccagtccaactggaccaggaacccagcttagggaaataacttattaattaaaaagcatgctaaattagcttgctagtcactggaggaaaggagttcttaattaaaatgaacacggccattaaatttgaattccatatttcccattagcagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgcactaagacctctctgttgatttttaaacaacaccaacaaccatagaaagtcgactctgctgtacatgagcctctgtgagccactttgttgcaggggtgcagctcatgtgaagtcacgaagaaacgtacaaacacagagccccttgagggaaggacaagctgcttacccactgggaaaggttatactaaaatcccacaagtaaactccaggaaacttcatgctttcttctaatagaatatttaaccaggtagctgtgacctaggggaagggatatattcagacctttgggcatagcttgagtgtcgttgtaaacttaccctgagtcctgtgattcataattccaccattaccaccggtccttgaataaacagagttgtgttttgactttccactacagatccagtgagacctctcagttatccagggatttgtttcccgcttgatagaaacagtgaaggtcttgtaaagttcccattttcactcactggttcactccacaaaatcctactgattctctttgatgtgccaggcactgttgaggctctagagttatatccttaaccaaaaggacaaaattccaggccctaatggaattgtgttctttcaatgccccaaccccacccccccggcacccccaccgtcctcggcttcctgacccatgcagcagtagctcctatgattgaaaggggtaagtgggagctgtggcaacaccaggtccctgtgaatgtcgtcattcaaaagcaaccccacaccctgtggaattacagagcagtccacgttggacttgagagatgcaagggtcatgactttcactacctccccatttaattctgcagtttgtttgatgtggaagaatgttctttgggagttacaatgtattatgataagcccaatcagctgatgattcagtcacagccactgtttcacaaacttcctcacaggactgaagatcacctgggaggcagcagttcagctgggcagtggggcagggattggatacatttcctctatcttctttcaaatagcaaagcccagaactgctttgctttcataaggcagaccaagcggttcattttgaatattttgcctcagggatgtgttatgccaaggctctttcccacaattgataatgaatggtccttgatcatctcacccccatcacacctgtgtccctaaatggatgacctcacggcacaaggacggaaggactcagggactaggaaatagtagactgtgtcagaaacgtgctttccccacgtacaaaagatttggattgaaaatacagggacctgtcaccacgagtttctggggcgccagtgttctgccacggagcttccaactgccccatgccgtgaaggcgttgcagatgtgctgatatcagatgcctctcagctcatttagtgatacatgcaatgaagaaaatgaaataagataatgatctttagccgggtttggcaaactatggcccttctgccaattctggcctgatgcctgcaatgattctaaaacataaagttatacttaggtacccggagcctaatcatggcccaatagattgaacctagtgttctcgctgtcatgataatgcatactgttaatcaaaggggtacattgaagcctctcatcgtgattgtggtttcatcctctaaccacctgtagctttcagaggttctggtttgtcatttcactcctcttgtgagatgcataaatctttaactgtacatctgccaaagggatatactctgtgaatgtaaacaacccctctttgttatgcttagggtgtagttctctgttttgtcaaaatttcaaattctacttaatcagccctatttagaaggatccctgttcccttggtgttggagaatatgatgttttgaattgaagctcttatttctgttggcaaacttgaggttgcacgtaaacctccagtatccagcccaggaatacagagtttattccatgtttt

SEQ ID NO: 1840 - DNA, 6950 bp, artificial
  synthetic oligo
tgcatatttaatatcatgtcattttttaatagagatggcttttaactttccgcttcaaaaactccttctttgttttcttttttttctatattgatttggctcaaatgtccagtgcaatactgaatagacgtggtaaagctggcatccttatcttgttcctgatctcaggggaaaagctttcagtcttaccaaactctatcctcctacaagagactcacgtcacatgaaagaagcacatagactgaaagtgaagggattgagaaatatattctatgaaaacagaaaccaaaaagagagcaagggtatctttacccatatcagatgaaatacctgtaagtcaaaagagagcaaaggagacaaataaagtcactctataataatacggacatccattactcaagatgatttaacaattgtaagtataagtacagccaatacgagaccaccaacatgcataaaggaaatattagtagatctgaagggaaagatgaaccacaatacaataatagtaggggagtttaacacccactttcaataatggaaagatcatccagacaaaaggaacattgaacttaaactacaccttagaccaaatggacctaacagacttctacagaacattccatcggagagtaacagaaatacacgtttttctccagtgcacacagaacgttctccaggatagattggtcctatgtttggccacaagacacgtcaaaacaattgattgtgaggactgaagtcatatcaagtatgttttctgatcacaatgatatgaatctagaaaccaataattggggcaatcaggaaattcataaatatgtggaaattgacgcacgagccactgaacaacaaatgggccaaagaggaactcaaaagtgagataaagagtaccttgacacaaacaacaatggtaatacaacataccaaaacgtatgggatgaagtaaaagcctttccaagtgagaaattcatagcagcaaatgcctgtatcgagagagcaaaaatatcttaaataaaaaagctaacattacacctcaaggaactagagaaagacaaacacactaagaacaaattagcacaagcgagaacataacaaaaatcagagcaaaaataaatgaaaaagagactataaaagcaatagaaaaaatgcaatgaaatcaagagttggattttttaaaagataaacaaattcgtctttgttagctacactaactaagaaaaacagaaagaagacaacataaagaaaaccagaaataaaagaggagacattacaattggtaccacagaaatacaaaggatcataaaagattactatcaaaaattatatgccaacgaattggaagacctagaaataatgggacaattcctagatacgtataagctaccaacagagaatcaggaataaatagaaactggaggacattatgttaagggaaataagcttggcacaggaagacacattttgacacattttgcatcttctcactcatctgtgggagctaaaaattaaaacaattgaactctgagaacaatgaggaggtttctctgcgggactcttgcttgtgggttctgggcttgagaggcacctctgggtttgagctctccgctgtctctgctacacagggactctgacagtccacagacgtcgtgtcacccagtagctgctcttcggggcttggggagcgcggggtgatgcccgggccattcacagtctttttgtaaattgcgaccatgaagtgcattcctgtctaaagaaacaaaaaatgaatacacgctctccagttttttttttttttttctgctctgacattttttcttcattttctttgccaatatcaaacccgagagaagagataggaattgcagatgtcaccccgctccaaggagaacagagagatggagaagaagaagagccatcttcgatgcctagtggaaaggtagaagctcccaagcaacatcctaaacctctttaccgtgattaaggctgcatttttcttttctttcttcccaggcgttcagtgaacacttgcccacctctcttggggtcaggtaactgaatcacgccctttgaatcctgcagttctcagtgcagacaatgttttgcttgagagaagctactttctaggcacttcaacattcattcaagagagctgcctcacaagtgccctgaatgcgggaaaggattccctcataggtccaaccgttatcggcaccagccagttcacgtgtgggagacccctgtgaatgcacagtgcataacaagcgaataataagtcgcacctcacagcacctgtgaagacgttgtgataaggaaatgtatgagtgccttgagtgcaggaaaggtgtttctcctagatcaagtctgacaggacacccgaatgctttcacaggtgaaaaatctcaaggttgtcacagttgtggggaaagctttagtcagtcgacagctcttttttgcacccgagaacacacgctgaggggataccatttatatgtgatacttgcgggacaagctacagacagagatcaagtcttgttattcgcttaagaatctatacgtgggagaagccatacaaatgtaggcactgctctaaaagcttcataaagagagcagaccatatgatgcaccaagctgcacactttagagagttctctaagcatatcttgagggaaacaggtcctacagaaatgaacagttactcataaaggcctttgcttgcggtaggctgtcttggaagtagagttttcgtctacctcatttaagagaatagctttgcattttgctattaaatgttcacctacccttgccactgccctacattgcatatttttctgcctaggcagatcttgcttcatcatttcgataaaaatgtctttgtcccaagccaaccacatcataggggtaaggagtatgtaagcagtggcattcctttcagaactcaggaccatacagcaggaagcatgaggtgcccgactgatctttatctatgcaatattttaatcaagtggacaggcatatgctcttcctatttcagtctcattaccacattgtctgagcaattgaggttggagatgcttccctgaacggtggcgaaaagtatctctcttgactcctgcccccagcacgtgccaggatccctttcttcaatacaaccacagtgttctgtttgtgcatgctttgagccttcaacacagtccacctttgaagtatggactatttcgaagaaataatggcaactcataagcactacgagggacaggaaacactggccaacacatacatagcaggaagatgaaatattggtgtgcaggtgctattcacagtgagctttccaaaaatatcagcctattgtactctccttctatgttgtttgaaacgataagtgcatttaaggctatgacttgtactttaagtctagctttggtcacattccataagttatagacaatgttcttacttctgattttgcacgtttctcttttcagtttcgatttcatttcctccttgcctcaagaactggacaatgtggacatgtaccggtcaattttttgttatattgcactttgattaatagttggggttctttccatttctcctttgaagtttacttagatgttcttgaaggattatatcctaaagaccataagaaaatcaggatttgatttgtagagcgcacttgtagcatgcagtctggggactcacaattgcttttgtttcatcaggacacagagtagatggccttgctccccattctgaatgcctgcatttttgtactctccattccttcttaagaatttgctgtcatagagcaatttgtaatcttttgtcatagagtgattttgctatagagatgttctctgttacggagtaatgcttaacagttgcctaggtatgaaggtagcaatagaaaagggaggttaaattgaaaacctaggaaagaccaagcctctctaaatcaggctgacaacagtctcctccagaatcccttacttgtcttccctcctgaacatagagaggacctgtaggggtccctctaaggtttttgcaaccttgaccaccccccttacccccaccccccaccccggagtctgcagggatggttccatagtgtgccaggtatgttgtccaggctaaaatccaggaaagtaaggaatacacaggggaatcagcccccaggcggctcagcatcaggtaagggaggagagacattacactttgtccgcttgcccctgcagcacacaggccatcccgagcagaaacagtcatgggcacctccaggaaactgcacgggctttcttcttgcaacactttctcatttctagcccggtcatatgggctgaatactgccatatataaacaaagctcacccttaaacccgggccagccctctacttcttgtcctccagtcctctgtaacagatgtgaagtagaatgcatccagagctcatccctctggctctcttttgcatttacactaagctcactcagcccccacttcttggttgttaacagttgggtttgcggatgttgctggattcctttctcccatccagttgtttagtttgcatgttcagacaggacttctcggaggtctagcaagcgttggtttcacattgttaaggatcttgagtattaaaatgttacaaacatattgatatattttagataattactttcaattggcatctctaatactgaacacaagaataggaacgtataaattattgaagacgacttcaagaactaaaatgtgaggccttttaaaaagagtcagatggtatcaccaggtctgagagtggtctcttgagtcttatcagcattacattttacaaaaattcttcttcggacatctcttcccaactaggttccctcactaagaaggagagagtatgaaaggcaggcagtgaaagacaggaggcctctcatcctagtcttcagtatgagaggcgagacctccactgctctacctgctgaccctcttcggtctatcctgggcagggtgaagttcctcctcccaagatgttactctcagggcaatttcccccatgcgaaagagccctccaatgcgccaaggcaggaaagaagggtgaaggacatctgtggttcttgctacaattcttccccttcattatgagagatgacataattagcattgagaaatctcccaaatgtttaccaactgaagcgcctcgacaagtctccaggtctttgttactttctttgttgtggttgtgctaaagatggctgtaaatgatgtcctaacaatctatggcaggcagaaaaaatgcccttcaagatgtccaagacctattccccagaacagattaatatggtaccttccaacacaaaaggaagtgtgcatatgtgatcatgtcaagggtcttcagttagggacattatgcagtattatccaggtcaatccaaagtaattacaagagaccttgcaagagggaggcaggagggtcagagtgagtactaggacatatgaggacaggagctaaagtttggagtgatgccaggaagggaccctgagccaagcaacgcaggtgtcctctggaagctgaaaaaggtgaggaaatagtttgtccagaaaagcctccagaaggaactcggcccagctggcaccttgattttagacttctgtcttccagaactgtactaaaataaacttgtgctgttttaagccactaaatttgtggtcatttgttatacagcagtaggaagctcctacacctatcatcaagagggggggtctatgccccctgcccttgaatcttgacaggttgagccagctttaacagagtacagcacaagtgaagctgtgtggattctgaggcgaggtcctagaagacagcactgcttccattttgttctctaggggtacaggggacagacgttgagcaccagttaaaggtctgtgtctgtgttagtttgatgcttgccctgtgtatgcatgtgtgtgtttatgcttcctttgaagagagttctgtgctgtgtttacttccatattggctaaaggttcctcatttgccttgtgtcattaacacgtcccagttggaaaacctcacagatttgtttctctatgagcacaatctgcttttaaaaatcactttctgaatcctctgtacttgcatgaaacaaacacctcacagcgtgagattttaacactttctagctggatgtgttatgcagacacataaaaggccccctttcacattaaatttgctacattttctgttttcccatattgcttcacgctgaaaatatacatttacagaatatatttgtgggggcaaaacatgtttaaatgctcattgaaaaatatcaaaatacaggacaccgagtgaaaagcacaacttctctcttgtccagttctaaagtctagaggcaatcatgatatttccgtgattcctttcagatattttgctatagaagtcttctctggcatttcgaaaataatttcatattacatacattgtcctgtaaacttgcttttttcgttttagaatgtacacgggcttcattgcacattggcacacaaaaatccatcacattgctttcaatgaatgttgtgtcatccacagaacggactcaccagagtgcattcagacaggcccctgttgatagacatgtgagttgattccaactgataaccccctggcaagggggacaggcaggtgaatgtggcaaggcgatgacaaggatccgagtacaaaattgctacctcacacggccatggatccattgtcgaacacagtctggatatatgtttacctggggaaagcaaacagggcaagcgtcttgatggataacccccttacaaatggaaagttcaaagtggaagtatagatagatatctcacttggttggtgggattttaacaagttttgtttataccagttatgaggaaaaagatcaaaggccccctctaacacttagctggtcatatt

SEQ ID NO: 1841 - DNA, 1050 bp, artificial
  synthetic oligo
catcgtttctatgattcccaagctgtctactgagtaaaacgctcagcaccgatttagaggccaggctgggtcttaagtattcatccaccttcctcctgatgctccatgcagatgtgctgggacctacttcagagtgtccctgagccatgactgcttgactccacagatggcttcaggaagacagcacagaagagggacctgtgaaagttgatagaatctagaattacctgaaggagaagcatcaagtagccccagaagcctctctgcacttctcctccctaacacacatgcgtgcatgtgcacacacacacacacaatcataaaagtcagctttgtggcaacttgtgatttttaaatttctttgagtttcacatatgcatgagtatatttctagaatctcttcgttggtccatggacatgtctatcaattcttgtctcattcaccaatactacagagtaagttttgagtccagaatgacaagccacccctcttgcataatccttcacatttttttggaatataatttcatccgatcttccagttacacacacactcaaaattctgctataaactatcattaggattgtactggatatactgatttatttagaggcgaattgatgccattgaaaaaattgatcttcctcttaagaaaaatgtagtattttaaaatattatgtgactattcaaactgaaggctcataaaaagtggcatgtgtgttttccttgtatttaccttcattatttttctaggtgtttcataacgtttgcaaccaatgtaaatgggatagcttaaatctatgatattccctatttattggaagactgtgcaaatttttaatttatttatgtattcatttatttttattgtagagatggggtctccttatgttgcccaggctggtcttgaactcctgggctcaagcgctccaccccgctcagccttccaaagtgctgggattataggcgagagccactgtgcctcacctagtatgcaaagtttttacgcatttaacttctatcaatcagcctctcctgacctatttcct

SEQ ID NO: 1842 - DNA, 1050 bp, artificial
  synthetic oligo
ccccatatctgttctcagccctcagccctgggtctctctgcagctcctgcacagcccttggcaaaactgcctcctgccctgtctttggggccagaggactggtctctgcctgctcctgctgtcccttatgttcccctacccctacatgagggcaccccccaagctctgcatttggagacagggaagagtgggagagacgcattcctaccgtcccctcccctagtcttgctcttctgccatgtcagcccatgctccctaaggcccctagctagcaaggccctcccagggccagagtcccatcctccagccccagacggcctctagaagcctactgtgtactgaagtgatctgggaaaaggagacctgcctgagcacacagcagctctcagcctggggtgggcagagcagatggaggaggggcttgcagaggaggccattcccgggggaagcaaggacgtgtctggtggccaggcaactgaggtccccatctctttctttctctttcaggcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtca

SEQ ID NO: 1843 - DNA, 3100 bp, artificial
  synthetic oligo
cagctggaccacgcaggatcggccagccagactctgagtgaggacatatgaaaggtgaccagccactggacactcagccgcaaggagctggagcagcgggaggcggcatggaggctcgaggaggagtccttcaacgcctacttcagcaacgagcacagtcgcctgttactcctctgtaggcaggtgggggtcgggtgactggtcagcgaggtgaagatgtccaccgagagggacctgctgcagctgggaggggagctggcctggacatcatacgctgtccaggaggcgggcctggtactgagcacgggcctgcggctggcagagagcggggccgaagcggccctggagaagcaggccctgctgcaggcccaactggaggagcagctgcaggacaaggtgctccatgagaaggacatggcccagcagcagatgcaaagcgacctggacaaggccgacctcagtgccagagtgacagagctggccctggcagtggagcgtcttcagaagcagaatctgtagtaggattaggtcaagaagcccctcggcaagcctgaggccctggaatccctgcggctacaggagcaggtggccctggagacagaggatggagaggggctgcagcagaccccgagggacctcgcacaggccgtcctgttggacactgagacggcgtccagctgagcggctccgagcacactgcggacgcgtgcgaaggcagcctgcggggctctcaggccagcggatcccatccccacccaccgcagtgctcctcactgggcagcagccgttcgccccaccgaagccggtccctggctagctcagactcctccaggctcgccctgattcactctgccctgcacaagcgacagctgcaggtccaggacatgcgtgggcactatgaggcaaaccaggacctgctgggcaccctgtggaagcagcttagcgacagtgaggttgagcggcgggccctagaggaacagctccagcaccagtgggacaagaccgatggcgccgtgcaggcccaagaggacgcccagcgcgaggtacagaggctgcggaacgccaatgagctcctgagcagggagaagagcaaactggcccacagtctgcaggtggcccagcaacaggccaaggaccttctgaaggagcgtgagaagctgcaggctgcccaggaggggctgcggcgccagcgggaccgattggaggaagagcaggaggaggcggtgcaggatggtacacgggtgcgccaggagcttgagcgcagccataaacagctagagcagctggaagggaagcgctcaggcctggccaaggagctggtggaggtgagggaggcgctgagctgcaccacactgcagcgggacatgctgcaggccgagaaggccgaggtggccgaggcgctgaccaaggctgaggctggccaggtgaaactcgagctctccgtgaccaagctgagggcagaggaggcctccctgcaggactccctgtccaagctgagcgccgtcaacgagagcctggctcaggacaagttggatctgaaccgccttgtcgcccagctggaggaagaaaaggcagccctgcagggccggctgcggcaggcggagcaggaagccaccgtggcgcgggaagagcaggagcggctggaggagctgcggttggagcaggaggcggcgcggcagggcctggagggctccctgcgagtggcagaggaggtccaggaggcgctggagcagcagctccccacgctgcgccatgagcgcagccagctgcaggagcagctagcccagctctcccagcagctgagcgggcgggagcaggagctggagcaggctcggctggaggcacagtggcaggcagaggcgctagccaaggggtgcactggcctggtcatgcagctggcggccgcggagcctgaaggcaggaccctgtcagaggaggccacatgcctgcgcttggagaaggaagccctggagggcagcctgtttgaggtgcaagggcacctggttcagctcgaggcccgctgggatcagctggaagccgatgggcaggccctgctgttggccaaggagaccctgactggggagctggcgggcctgcagcagcaaataatagctacaaaggagaaagccagcctagacaaggagctgatggcccagaagctggtgcaggctgagcaggaggcccaggcctctctgagggagcagcgggcagcccatgaggaggactggcagtgagtccagcgcgaaaaggaggcagcatggcgggagctggaagccaagcgggcccagctgcagagtcagctgcagtgcgagcaggaggagctgctggcccgactggagatcgagaaggaagagctgagcgaggagattgctgccttgcagcaagagcgcgacgagggcctcctcctggccgagagcaagaagcagcaagccttgtctctgaaggggtctgaaaagactctgtcagagaagttgtcagagaagttgatgggtacgcggcacagcctggccaccatctccctggagatgcagccacagaaactagatgcccagagctggcaggagcaggaccggagcaccgtgaacgctctgatgtccaagctgagggacctatgggcccagctggaggaggctgatgtggcccacgcccaggaagtgaggaggctgcaagagcaggcccgagacctgggcaagcagcaggactcctgtcttcgagaggcagaagagcttcggacccagctgcacgtgctggaggatgcccgcgaccggcttcggcgggagctgctggaggcccagcgcaagctgcgtgagagccaggagggcctcgaggtgcagcgccaggaggcgggcaagctgtggcgcagcctgggcgagggtgccaaggagcgtgaggcactgcaggccgccgtgaagaaggcagagagcgagcgcatcagcctgaagtttaccaatgaggacaaggagcagaagctggcactcctagagggcaaggaggctggggagctttggactgggctgcaggaggtggagcgctcacggctggaggcttggagggagctgcaggagctccggcgtcagatgaagatgctggacagtgagaa

SEQ ID NO: 1844 - DNA, 1050 bp, artificial
  synthetic oligo
gcttgaactcttggataggtatattacgtgttacagttataaacaagtagtttcaaatagaattttacaataagttaaaagtgagttgcaggatataaatgtcaaggatctggaggaactagaaatttcaaacactgcaggtgggagtggaaatggtcacaccatgttggaaaactggcaacatccgcaatgttaaacatttccttaacttactatccaacattataaatgacacaagacacacgtctgggaccatttctcttttaatatacatacctttctttggtgtgactttatataatatctgggggatgataacttcaaaatatgtacacctccagcattaaccaatctcagattcaattatccacatgtctacgcaagtttaatatgtctaaagctgagttcttgctattcttcttatgcacccaatttggctcctctcagttctccacgtctcaaattggcaattccatccttaccacttctcaaacaaaaaactttgcagttactggcaggaataagtgacatcagcaagatagcggagtaggagttccagccttttttcctccaaaacaacaacaacaacaacaacgacaacaacaacaacttgacggtcattcatgaataaaaacagctccaaaagagcacaagagtccacttaagaagctatagcaacacagttgaagaaaaaaactgagaatacttgcacaaaaaaggtaggaaggacagtttcattttacctgcatcatcccatcccccagttgacactgctcagcatggagagaacattccctagctcgtgagttcctcttgcagggcaggatgaacaactggctctctcagtcttcaggacactgcctgggactgatctgctccagtttcactcactcagaatgttgagaaaactgccagctgaatgcttggagatggttaagaacaaaggaaatgggtaggggatatcagtgtctgccatgtaggagaagccactgtggtccccagtagcctgctttgcacaggactccagcagccttctttactgaagacctt

SEQ ID NO: 1845 - DNA, 1500 bp, artificial
  synthetic oligo
gtaatcccaactactcaggaagctgaggcaggagaatcacatgaacccaagaggtggaggttgcagtgacccgagatcgtgccactgcactccagcttaggcaacagaggaagaatctgcctcagaaaaaaaaaaaaaggtaaattgaaactgtatcctagtctactaatgaaacaattcagactggaagttaaccgataggaaactattcaaatgttcattaacagaaagactgataaataaattgtgattattcatacaatggaatgttatttagcaatagaaagaaatacattccggttatatacaattttgaatgaatctcaacattatggtgagttttaaaagccagacacaaaagaatgtataaaatatgattccatttatataaagttcaagaacaggcaaaaataaccaatggttattcagaacagggatgtctatgaagggtttgttaggaagaaggcatgagggaactttctggagttatttggataatagtaacatagatgtatacatttttcaaagaccataaaactgtacacttaagatctgtgcctttaaatgaactaaattgtacctcaaaaagtaagttaacaaaccaatgtatagatagatcatgctttgaattaatccatgtgtcactggtttaacctaagatacttgtttctttcaaattgaaatgaagtgagactgtcaccagctgtggtgaaaaagactcatttctccagcaaaaatccatccactactaaatctgtccactactccccatctccactactccactcaagtacactaggagcctcccgtgtggactccttgcttacaatcctgccctgctacagtcttctctctaaacagcagcaataccactcagagcatatcattaccatacttacaccttccaaaggcttcccttcacatttaggaagagatccaagctccttcctctgtcctacaaagtcctacatgaacgggtcctgccctcctcaccagctactctgccacttattactgtgttctagctactctgcccatctttcagttcaaaagcaccaagctctttcctgactctagacactcacccagcctgtttcttctgcccagaaagctcttccctgaccctcttcaactaactgtcccacattctgcaaatctgctgaaatgttatttattcagagagtccatccccgattctccagtctgttcggttttcctgttattcattcttatagtacactgtattcttctcttttgcagaacatatcctcatttatagttatatatttattagtgtgttcatttgtttattgtatgtgttccctactagaatgctgtttctccagagtctagcgcttattcaccaataaatatttggcgaatgaatgaatgaatgcactcatcctacaactagcttgaaagggttttatttgggacgattatgaaggctggcctaacgagtaagaaaagggaacattagtggagaatgttttttctact

SEQ ID NO: 1846 - DNA, 1200 bp, artificial
  synthetic oligo
gaaaagaaaagaaagaaagaaagaaagtaaaggaaggaaggaaggaaggaaggcagaaaggaagaaagaaagaaggaagcagcagcagaaaaagtatgtgatatgtaagtttgttgttgctgctgctgttacaaaaaaaatcgccttatgtagttacggaatgtggttaccaagtctctatacgaagaaagaacaggctattaataaaatccacaaacatgatctgaaagcccataaggacagacaaatatgtctccattcttcttgcctctgaccttattcttgttgcctctgacctcggtgacgagggtattctgtataatccaggaccctgcctaaaggagctaaactcaaagaccttatcctaaagatagagaaactgaaggagaatccagtggaaggtagaagaattgcaggcacagctgctgcttcatgccaaaaggtgaatcagcaggtcagcaacaatgggtatgagctacaaaatcaatgctgtttctcctcggccacattctccaatcttcaaagtatctccctgtcgtacaatctaactggaaacacacaggaaagggaattgtctgtaatgaattcacctagccaagctgacacattacaaggtgtacctcttgtcattttggtacccatgcacatctccttaagccatatctatcgctaaataaacacagtagcaaagttatttttctgcctaacatgagaaagttttcctgcttacaaataacatattaacacttttcctaaagaggatacaaagtctagtttttgtctctagatattgcacatttttcttcaacctgattcacactctacccttaatatcctatatctcaaatactgaaaataaagttaaatcttggttaatacattttagattattagctaaggggacgagaaccaaaaatatttgcttcatatgtatgtaaacatccatatcaagataaggaagtaatactcatagttattacagtccttgtttctgcatatggccatgtggtcactccttccactacccatttcatactccctttgtcctcagcaagcatcttccctggtgacagaccttttcctgatggggtgactcaaacttgaattcctgaggttcacggttcaaggccattagcagtcctgattgaattaagttgtattagtttccattggctttcatcactggatacaggagtacta

SEQ ID NO: 1847 - DNA, 1600 bp, artificial
  synthetic oligo
aatgtgccccctagggcgcccgggaatgatgcgcatggggaggcgtctcaccataagcaccgatcactcgtatggtccaagcgcaatggaaggaagggaagctgcaggccaccacgtgccctgctccaaccgaactctgggatctgtgtggggcgccagagtccctaggagaagcctctcgctcagtgggtgccagcctagagaacctggaagcgcagccctccctttcgctgactctggcgccctctaaaggcggccttcagtaacaactgtacagccgacataggcggaggaacacagacccttctcacacagcgggataaaaaggtgaatttggagctgacaggaaaatatatcttgtgacatatttgtctggctttgatatcggggtgatattggcttcatagaatgaagtagtgttccttcgtccgttattttttgaagacattgccaagtattggtattatttcttccgtaaatgtttgcagaatttacacgtgaagccaccttggcttggcttgtatttgtggggagattttaaattactaattaaatcccttttctttcaatagtcctatttcgattttctatttcttcttgagtcagtaatttgtcttctaggatttttttctattttatctaagttgtttagtgtgttggcataaagttgttcataatttattcctctgagtttctataaggtcagtattaattacccccctttcattcttgattttgataatctgtgagtcctttctttttttccttggtcagtcaagttaaaagattgttaggtttctttcactttttcagtgaaccaacttttgatttcattgatttttctgttttttttattttattgattttcttctactctaatttccatcattcctctcctactgcttgtctgtgttaaatacatcaatttaaaacttcaggaataatgaattacttgtttcataaaggaggacttagacatacagaaatgcttatgatattgcaagtagcagtcatttagacaagttaactaggaggaaatttgctatgctgaaaccagacacgtttttgtgtcggcctttattgattttgaaaatatcaagtctagtttgtaggaaggtgtttattgtatgagtagtttatttttgaatattttaaaatttagaatgtccattttcactaaatcccagaagtttatttttttcaagcttaaaggaaagtatgtattagccagcacatacactatcctctttgtgctttatctctggtaatccttatgagagcgccatgagttagatactgttttatgcccattttatggaaatagaatcgtagagtgcatatttaagcagccctcacaggtttatccagttggaaaagtgacagaacctaggtctgtcagatttcagagattgcacacacaaatactatatgacactgcctaccgctgtgagttcagcagagaattccttgtttatatggaaataacaaagctgatagtgtccaggataattggcatcagtttacaaaccctctgtaccccaatgttggtgattttaagtggggtcatctgtccactaaattaatcagatctcaggctggt

SEQ ID NO: 1848 - DNA, 1800 bp, artificial
  synthetic oligo
ccattctttttgagacagggtttggttctgtcgcccaaggtggagtgcagtggcgggatctcggctcaaggcaacctcggcatcccaggttcaagtgatcctcccatatcaactttcctagtagttgggtccacaggtgcgcgccaccacgcccagccaatttttgtgtttttctttttggttggttggctgttttgtacagccagggtctggctatgttacccaggcgatttcatcccgctgtgtgagaaagttctgcgttcctctccctacgtagctgtgcagttgttactgaaggccgactgtagagggcgccagagtcagcgaatgggagggctgtgcttcctggttcccctggctggagcccatggtcttgcagagtacaagccttcacctcgggactctggcgcccccaacagattcccagtgttcagctggggcaggacaagtggtggccagcagcttcccttccatcccccttgggctgtacgggatcagtgcttctggtgagatgcgtcccatgcacatcattcacaggtaccctagagggcacatatcccacaactcccagagggcaagtttccagaaagtacagccagtggtggaattttcgctgccattttgtgaggtgccacagccgctcctctggaaaggttaggacttcaggactgtgagtggggcagtttttctctggatgctttaatatcgccccagaaagtgtctttctggggtgctctgcgttgggtgtgtggtacggctccctgggtgatgtggttccgctctggagacaccaccgtgggtgcctgtgtcagccgtcggagaccgttttccttgggcaccttgtcttcgctagcagggtttcactaacttgtcaatgtgtcacggtactgcacaacattgataaaacaagcatctattatgcaactcgcttcgtgttccttatttagtggtaagaaaggcaagatgtaggaacttcctgttcaccttatgaacaccatcttgacatgccagactactagattgttaaacgtttcactcagttagaaggtccctgattttgtgtgggaattatttctcacataatgtcttgtaagtgtgtcgctaatgtgtctggattagttgctacctcctgcgcagtcagcataatgtcatcagtgcaaagaatggtgttacatctggtttaagagaaaggtggtcatggtccctaaggactcgtttaggatataaaccttgagagttgatataaggttgaaagaggagatgatagtacattgctgtcctttctagctggacccaaactcttctttatgacaactactgaaagaaaacaaaacattcacctaattaatattatatatcaggttgccagggatgtcacggttgctgacgcaacaaaaccacctgcagtacagcagctgcagttggaacaacaatttgattaagtttatggtccgatctcggctcactgcaacctccacctcccaggttcaagcagttctcttgcctcagcctcctgtgtagctgggactataggcatgcactgttacacctggctaattgtttgcatttcttagcagagacagggtttcaccatgttggccaggctagtctcaaactcctgacctcgagtgatctgcccacctcagactcccaaagtgctgggattacaagcgtgagccaccgcgccaggccccggctattttttgtatttttggtagagatgtggttttgccatgttggccagccttgcctggaactcctgacctcaagcgatccacccacttctgcctcccaaatcct

SEQ ID NO: 1849 - DNA, 1200 bp, artificial
  synthetic oligo
caaagaaaagccaacacatcctagctgagagcgagcaacatctaaggacaaatgtgccccacagccgagaacagcactcaaggaagagtccctcacaggctgagataaagcccgcgacagagagtgaccccatagggctgtgatcatgtgtccagggcacagccaccaccaccccggcccttgaacatagacagagctcccaaggcagagtcccccctcagggctgccaccgagcagggaagaaacacggccacacccgaggctgacacaggcaaccaaggcagggtccccaaccctgggcttaggtcatttcagcaggaaaagcccctcacatcactgagggagcccccaagaaaagccccccggacccacaacatagccgagatggggtgcccaaggaaaacgctcccccatggttgacacaggctcccatggcggtgtcctcagagtggagccactttcccagggaaccctaccacacacccgacagagaacacctcagaaaagacactttctgaggaaaaaggacactttcccgggcgaaattaaagcatccagggaaaaactgccccactcacagtcctgaagtcctgaccttgccggaggaggggcggcagcacctcacaaaatggcagtgaagttgtggcgcctccccactgttgtaactttgtagaaacttgccgtttgggagttatgggaaacgtgccccctcgcgtgcttgggagtgatgctcatggggaggcgtctcaccagaagcaccaatccggaaaggctcaaggcggatggaaggaagggaagctgaccgctttcgcgtgccctcccccagcctaacactgggaacctgtgtggggcgccagagtccggaagagaagttttgcgctcagcaggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcac

SEQ ID NO: 1850 - DNA, 6750 bp, artificial
  synthetic oligo
ataaaataaaaaacaggataagttgagaaagaagaaggtaaggagagggagaaagggagaattacaacaacagaattaaggccattgtcattttcccctttgatctgaatcgtcagctatttcccgcatgtaataataatagcggttgtctcttgttgaagcacctaatctgggccaggcacagggttaagccctttataagcatggcctcatcgaatccacagaacaactctctgagctgagtgccattgctatccctttcttgccgataaggaaggaactggggctcagagtggttcagcgaaggtccaagatcacacagctacttagcacagtgcctggcctacagtgaacaccctgtcaatggtagctgtcatggcgattattactatgattaatcataagaaatggctggtgccaccatcggctcaaagcagactgaagtctcaaggcccaaagcaggctctgaggtgcagactcccgggggcctgctcaacaggcatgaggacctcgacttccctttgtgcttcttcaagacttgggatggtggctccttgggtggtggggaaaatgatgccatacttgtgtctggctccttcttggttcccacaaatgtccttaacattttccattttctgagtggcttttgtgaaactgctctgatgtggttgacagaacttatagtgggatccaagtcaagccttcctccagaggaaagttggaagcctttaagggtcttgtcagtgctcacgtagcccacagcctcctgcctagcattggccaaggccaaggcttcccggcagtcagctctggatcacagcacactcattgattcctgcgctgtttccgggggtgggaaatcaatcccctatcggcctggcttgggcttgctgggccttttctccagggagagtttcgctggggcctctgatctgcacgtgatgctcttcatggttcaagggctgtcgtgtccaactcaagatgatttccttttccgtgttttctgcagcttttttttttcaggaccctagaaaaactttgaaacttaaaattactcgtgtgccaggaattcccacagcctccttgtgaggggtaggtgagcaccatatgctgtttatacaaaaataaatggcttccccccatgaagcacatgggcccaaatcactggctaaccccctttttaccttagcagctggagcaatggccctctggatgagaatgcgtacgcagatagaaatttggctctaaaaagccctgaacagtttgtttgtacaagagcttggtctcctagagaggcaggtggtgggcaggccagtgtccctctgtgggactagctgaagaaagcaggagaagaccaacatgcagtgctggacaattaccttgtccctccccggggcggactttcagggaggtcacctcatcttaatcaccacttccccaacatcatgagccctaggactgggtgcaaaggaggggtatctctctttttgaaattaaaatacttgaagttatcgcttcacttgggcaatagatgtctattaattcattcctcaagcaattattgagtacttactatgtgcacatctgaaattgtaccaagtgcaactccaaccacttgccccagtgctgacccaacaacaacactgggccaaaactaaaagtttggaagtgatggaggctgcaagttgacagcctgggcagctagagagtgaaagtgtcagttgctgcatttcgatgggattttattcaagcatgtattcattcattcattcattcattcattcattcattcaaccaagattcatgagtgtctactgtgtgccacatagtgtgctaggcactagggatatcagaagggagaatgccagctgtaatcaaagggaacttcagataacagtagctaacatctacagagtgtttatgtgtgccaagcaccatcatgagatggcttctctcttttaatgctcattccagcagtggcaaggaggtccagacagatggggaaactgaggctcagagattttactgacttactcaaagtcacatagccagaaagtggcagaagttaacttgcagaatccaagtgagcccaagggcctgaggttgtgttctttgctggttactacacattactgtacattactgcctgctgcagggattagctagctgcagcccacaggtcgagtccagcccattgactgtttttgtgctgcctgagagctaagactggtttttgtatttttaagtggttgtaacaaatcaaaagtatattttgtgacacatgaaaattatatgaaattcacatttcagtgaccatcaataaaattttattggaacacagccatgcccattcattcacgtcttgcctaaggctttttcactacagtggtagagtagagcagtggtgatagacctatggcccgcaaagtgaaaaatgcttactatctagccctttactgtcactgacagaaaaggaaacagatctcagcccatctctgagttcaggtggtccccagagccctgcctccctatcccagctcttcctcagcaactcagaaagaccaccggggagacttgagtgagcatttcagatgatggctgcctttgagttatttccagcacttccttcagagtctttgaggctgaaatgtttagggtggtattaggtttttcatcaaatgtttagatgaaaatgtagacagccgacttggggttatttgtgaacaaagccctaaaggcaaatcttattggtttttgctgagaggtgccaaattatctcagcctccactgggagctgcttgtggggccttatatgggcataatctcctaagccaggcttgcctcactctgcggcatggttggatccacttttaaggttatgtgtgaacatttcttgtcttcctgtttgctcaagctgtggggaacttggcttttgccacactttaagggaacataaatgctgtccactttgagcacgtttcatttgtatgtcaaagatgacaactgccttccttttggaattcttctccctttatatttgtctgtaggtggaaggaagcatttttgtaagtgctggagtcggggagatgtcgcttcattatcctagttgcttcctgggattagtgtgtctgaagagatgttgataaaggaaacatttactgtgtgtctataggcaatgaatgtgtctgaggcattccatgggcgttagcttactcaaaccttgcaaaatgccttcactcactctttcaacaggtatttattgaatgcctactaaatgccaagtcatgtggtaagccaagacagtaatggggagagctactccagactgggaaatcaggaacggtctctcagaagacatttaagatgaggtctgaaggataagaaggtgctggctgggagactcttcgtaattggattggaaatcttggtgcagacatttgagttaagagagttaatgaaagaactgcgccagcaactcagttgaccagagccccatgctgaggaacccaaggctactggggattttgttctagagacctcaaaatggaaccctaacctaggcttgccctggaaaatatagctctggtccaaaggagatcagctgagcaagtgaggctccccccactattggacaccaaattctgcaaatgtttatggggctgttctcataagcccagcactacctaggttttgggaatccagagacaaatcagagagcaaggagctcagggtctagtggaggaaataagtcatataatcaaataaatgactcgacgatgtactaggtacaacaaaagaaatatgtataagatctcaaggtagcacagaagagggggtgctgaacacacttgggaggcccagtaaacagccaagggaggctaaattttgaagagccagaagggcccttccagaacaagaaacctgcatgaccaaatgcccagagacacaaagccacatgccagaggcttcatgccactgggtctttggggaataagaagacctgttattttcgagcctgaagtacaaggtagagagtagtggacattgagatttcagcaagggcagttcagggtgagctttgggaataagtgtttcggatttgagccacactaaaggtatgtaaacacaagaaaggagatgtctgtgttaacttgccttgataatgcccctcttgttacccaatcccactggtttcaacttcatcttctgggaacctatggtatttcaaagacactgcctgatccctttctagacaaattttatgcttttggaagtggcatttccccgctaagtactttatactgttttcttacaactttgcaaagcatctgccatatggtatttctcccaagtgagagattattgcctctttattggagggggggagctgaaatgaagtcatctgtccactgaagtgacagctgcaagcagagatgtactctctaggcagcaggcctgccgtcagagcccaacccggtgcgccttctccaagagcggctgtcccctcccagcctcctgtcgccgctttccctttcttcttgcttcctgttatataagagcatttttgcagagatgagctctgggcttgttctgaatattttaggtgtcaaacatcctgtttttctctgagtaatgtgaccctgtcaatgacccactgcatttcagaatgacatcatgggattcaaccgagaatggttgaagagaagtgattatgggagctcagggacctctgcttgcccctttacctttcagcaagttgtttggagatgtcaaacaagaagtctgcaaatgagtgtctgctttgcacaagagcaggggttggcagactaggaactgcagaccaaatctggcccacagagcaaatccattcccagctgattttgcaaataaagttttattggcattcagccatgctcatttgtttgagtattgtctaaggctgcttttgcactgcaatagcagagttaagttatgtaacagaccccatatggcaggcaaagctgaaaatttttactatctggcccttgcagaaaaagtttgctgaaccctgcgctgaagctctctcctcctacaccctaggaagagggcacatggatttagcgtgctctcatcccatgactgagtacccgcccattcctttcccctcttccccaaacacctgatacaacaaaaaaggtaaaggttgattttcagcaagcatattggggctttcgtatgtattaaatgtcatcagaacttgcacatttattaaatgtgttgcctttctaagaagttccctaaagaaattgcacacacttaggctaggcacggtggctcatacctgtaatcccagcacttctggaggctgaggcaggcggatcacctgagatcaggagttcgagaccatcctggccaacatggtgaaaccccgtctctactaaaaatacaaaaattagctgggagtagtggcacacacctgtaatcccagctacttgggaggctgaggcaggggaatcacttgaatctgggaggcggaggttgcagtgagccgagatcacgctattgcactccagcctgggtgatagagcaagactcttgtctaaaaaaaataaaaagaaaaaaaaagaaaagaaaaatgaaattgcacacttattccaatgtggctgccagtgtgccagacattgcagggagtactcttcagagccaagctatgtgacacctgagaaaatccacttcaccttctttttggacccaaagtagtgcagccttgttggaacatctgcctagttgccatggatcaatgttggcttattttttcaaacaacagcaaattcagcactaaggatattccaaggaattggttgcatgttctgaggttagttccttaaaaagtgctcaacatacgatgtcttcagaggcaaggtatcttcacccaaggacttgagagtcaaagttagactttggaaacaacttttggaattgtagtgcatgttttcagcatttgggccattctatgtcttacaaaatgaaatgttcagtgtgtggctctctcctctctatttagggactgtatccatacttcaaaggactttaccatctgtcttgtatttccccatctcttcccagctgctgttagtggattttgctatggcatggtgcattgtacccatttggctaataatggcatgagctgagggttgaggaagccctctgctcagttccgtttatcacagccaagtttggataggaaagagtcccctaggagctggaatgtggtatactatggatgggcatgtcagcattcactggccctgctcatatcatggaccacagtgtgctctggactgcggggtggaggcggtgtggagtttggtggttttagaaaaccgtgaaatgcctacttattgctccacatttttgctttctcattttccttaagcccattccacaatgagggtattggtgtggtcactcctgaagcaaaaagataacaagttgcttttcagctttttagcttttttggtcatttcttacttcttttcctccccgcctttgcatccagagccactgtctcccacacgaagcgtcttaaatttttatgagctcacagttgcttcactgatttctgtgctgccagagtctgagatgcaggactcagcggggacttgctcagatctgtttgtgtatatacttcccactaaactcgatgtgcttgcatgagtgagaataatcaagtgcattactcagaagcaaggaagagtagggctggag

SEQ ID NO: 1851 - DNA, 4850 bp, artificial
  synthetic oligo
ctgtggttgccgtcctcctgccctgctgcaggtcctatgtgtatgtatttttaaatcaatgtatttaagtactataacaaccacaatagtaactgacctctgtaaaggaatgtttaggttactaaacacttttacaggttatctactctacttaccagtttttacgtacagttttcaaccaatattgcctttcaaaaacaggaaaagataatcttcacttaaccaagattagcgtttttcattttcccccgaaagtccagaatgggaatgacttgacattgaaaagccttaccaacaaattaaggaatgacacgtaggcagcacagtctttcaaggggctattttccaaaaattcatttaaaaaacagttcttggctgggcacggtggctcatgcctgtaatcccagcacttggccgaggcaggtggatcacctgaggtcaggagtttgagaccagcctaaccaatatggtgaggccctgtatctactaaaaatacaaaaattattagccgggcgtggtggagtgtgactgtagtcccagctactagggaggctgagacaggagaattgcttgaacccgggaggtggaggttgtagtgagcccagatcgcgccactgcactccatcctgggcaataagagtgaaactccatctcaaacaaacaaacaaaaaaaaatcaaagatgacttaaaagactggagagacacaagagtcttggatacgaagactcagcatagtaatgatgtcagtcatccccaaatgatctacggatttgacataattcctatcaacatccgaataaataaaataaaataaaaaccagttcttgtcccaaaagtaattgaaatacacttctttttcatcaggaaaacagtgtctaggttcctaagatggcccacaaatgcccattttacctcccacaattctgctgagctgcagttcacactcattacactagcctactgttgaggcaattccctctggaactggggaattccaccaattccctctactcctttaatgagtatgatttgcctaaaaagccatgtcaggaattccgaagtcaccctagacctcttcctatctcacatcttctatatccaactggccactaaagcttatcattactacccttctcaaatccacctcaccatgccgtatttccatcagcttttacttgattcacgtcctgagacctagtctccctcatagtacgtgaactacatagtacatagtacatggagtgaggagggtaacatgccttagcgggatgatggtttctcggaagttggtagattaagagatcaaaatatggaaggggatatccatgttggcaaggatagatttgactaaaatgtgctatgtccagtgaacgaacaaatgtaccatgcaatgttaaagattttgaatactggtgaatattcgtatggagttggttttgtatgtaagtgtaatattgatgtattacagttgattaggagattgctaatacttgcttatatgcatgtactgtaagctgtttagtactataaggcttatgtatgtactatgtacaatcaagcattaatagtactatatattattcatggggactagcaggttggtagccaggtgaccaggcctccatttcctctgcctgctttttaatgattaatattcctcaggctcttttctttgtaaaagtctcatcaggggtggcactactggaccatctaccatggcaactatgaattcatattttcagcactgatctctcatgtgctccagatccacagattcaatgatctattatacatgtttgcggacagctaaaattcaataggctcattttttctttcttccaaaaaatctaccccaccccctagccaccaccaattccctctactcctttaatgagtatgatttgcctaaaaagccatgccaggaatttagaagtcaccctagaccttttcctgtctcacaccttctatatccaactggccactaaagcttatcattactacccttctcaaatccacttcaccatgccgtatttccattggcttttccttgattcacgtcctgagacctagtctccctcattcaagtctatatgcaaccagatatgatcatttctctgtcttcctaaaagttcagtagcttcctattgtctgcagtagcatttctcaaactggcaaaagagtaccttcaaaattaaacaaaaaatttcaaaaacctcccctacataaattgaactggattaaacaatgttaagcaggcctctcactagcaaggttttgaaatcttacaatgcacaatactacatatttccctgtcatgaggaatcggggtggaggggagccccaactgggttccaaggacaaagtcaaaacttattgcaagacatgtaagatcctacagattctggccctgcctagctgtcaacgtgatctgccattcatcaatgattatcattcacccattacaaaccttacgtgtcattcacttacaacacaatctgtagttcttcaaagagccctactgttttctgactctaaatcctttatatacaatattccttctgcccagaatgccgcccttctctaacttagtctggttgaagagctcctacttgctcttccagggccagctcaggctactaaactttgattgtcccttccacctcctagcagaggactccttcaacctttgtcctgcctctgcagatatcagagcgcttgtccaacactactgaatttagagactaaaaaccttaaaggttgggaaccaggcaggcatccagcagtgtagctgaataaaggagacagggcaagactcggggaagaaggggtggaatccctcttctttttctagtcaaaatttgacaacaaagtaattttgtctttggtatgctcctacatctcatccctatcctcctttcccagctctcccaataccctgtgatatggtttggctgtgtccccacccaaatctcatcttgaattcccacgtgttgtgggagggacttggtgggaggtaattgagtcatggtagcaggtctttcccgtgctgttctcgtgatagcaaataagtctcatgagatccaacggttttaaaaagaggagtttccctgcacaagctcttctcttgtctgccgcaatgtgagacatgcctttcaccttctgccatgattgaggcctccccaaccacatggaactgtaagtccattaaacctttcttttgtaaattgcctagtctcaggtatgtctttttcagcagcatgaaaacagatcaatacaccctgtgttcccaggtcccttagtgacctcatgtaactctatacaacccccaccacagcactcttcttcagatcaactacttgctcttcctcttaatcaggagcccttctgttcagaaattattttattttattttattttattttagacagagtctcaccttgctgcccaggctggagtgcagtggcacgatcttggctcactgcaacctccgcctcccaggttcaagtgattctcctgcttcaacctcgtgagtagctgggattacaggctcccgccaccatgccaggctaattttttgtatttttagtagagacagggtttcaccatgttggccaggctggttttgaactcctgacgtcaagtgatccacctgcctcagcctcccaaaatgctaggattacaggcgtgggccaccacacctggtccagaaattgatacataaatgtgtgacagcttcttgtggctattaacctaagatgaatctctaagaaacaaaatttaaaaagaagtatggagaggataagggtggagcaggcactgtaacacacagaaaggcctgctacaggttctttgcctggaaactaagatcagatcctcagtgggctgcgcaggggaagtcattccagagaattttatgttcaatcaacgtgtaacacctaacacgctcctacttgacacaggcacactctttcctaaatgcattccattccctcaactttccaaagttcccataaggagtcctactatgtgctaggaatccagcacatgcatgataaaactccatcattcttttttcatcattttcaactggctactattaagtgcaccatatgggccctgagaatgaagcattgaaaaaggcaaattcatggagtttacaatctagtggaagacacagataaggaaaacaataaataaacgtgccatttttctgacagcaatgagtgcattcaagaaaataaaacagggccgggcgcggtggctcacgcctgtaatcccagcactttgggaggccgaggcgggcggatcacgaggtcaggagatcgagaccatcccggctaaaaaatggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaagaaaataaaacagggtaataggataagtagtgatagggcaggggagtgacagagtgtgagaagggctcctttaaccaggatggcagagaagacctctctgtagggaagacgtttgcattcttttttcttttttttttttgagatggagtttcactcttgttgcccaggctggagtgcagtgccgtgatctccgctcactacaatctttgtctcctgggttcaagcaattctcctgcctcccaaatagctgggattacaggcacccaccaccatgtctggctaatt

SEQ ID NO: 1852 - DNA, 1600 bp, artificial
  synthetic oligo
tcataacaaccccaggaaggtggattattgtccgtattttacagatgaggaaactgaagagttgagtgaatttcctagatacacacctctggtaagtgccaaaatgccaaatccagcttccacagggtcacagtacagctgttcttgcccccctcaaagtgccttccccaaaagatgattattctttttttgagacggagttttgctcttgtcgcccaggctggagtgctgtggcgcgatctcacctcactgcaacctccgcctccccagttcaagagattctcctgcctcagccccctgagtagctgggattataggcatgctccaccatgcctagtttttgttttttttttttttggtatttttagtacagatggggtttcactatgttggccaggctggtctcaaactcctgacttcaggtgatccgcctgccttggcctcccaaagtgctgggattacaggtgtgagccactgcacctggccaaaagatgattattctatgggtattccagactcttaatgcaaacacgtacatggacccaaataatgagatttccattttaggagttatccaaaggcaggcaaggctttgtaggtttattttgctttagtggctgtgcatctttggaggtacagccacaaaggacgaacttggtcctgttcagacttcagagataacagaactgacatatgcatcagtgggaaagaacaatgtgacaggagtaggagattaatttttttttctggagtgaaaattgtgtacagcagaggcaatttatcgtgtcgtatcatcactgaaattatctccctgctgtctgccagcccagctttgcttcagtggtttccttagtgttatttaagcaaataaattatgtttgcttctagctttacttgtttacatattttgtgcactgctttagtaagagagtgcattttaataacttttatgtatctaatagtcatagatatttgtaacaatattttcgcagtcatatagtaaaaacaaacattgcattcttgacagggtcagattgaccatcatttgctagcataatcctttatctttgatgtcaacagcactaaattagatacagtttaagcaaaaacacttgagcataaagacttggtaggtttttcacacagctggacttcagttgtggaaggttaaggagagtatagttgaagaggatgtttttaaaggggtcataataaggcctgttttaatgctgcttgaaggacgtaagattttgaaatgggagtccccataaatggactggagaatctacacaacatttggaactggtctctttcctctgaaaatataaccttggaagttggtattagctcaattttacggaggcatcttggggaaattgcaataaccttgccccttgccttctatttctcatccatttctagttaaaaaatgtttacaggcagccccactgaccacttttaagagactgtaaagaaaaagtaatgagtgatgattgaacataggtattagcatgtttcttttctcaatatctttgaaattccagctatcttgtgcaggagcccaggcattaggatttttttattttattatttttggagg

SEQ ID NO: 1853 - DNA, 1600 bp, artificial
  synthetic oligo
cccatgccactctccaaggttggatccagtttcctgaaccccaactgttctctagacttgttttattcccttgttttgctacaacatatcctccagtagtctctaagtaggatgcacaagagagaaagtttctggtctcttgcatttgtgaaaaaggtctttaacctcacacttgatgagtattgtagctgggaatggaattctgggttgaagatgatttctctcacatttttatagcattgctcagttatcttgcagcatctagcattgctcttgagaagcttgatactgttcggattctcctttgtatgttgtgtgactgattctttggagggttttaagatcttctctcaatccctgttgtgttggcatttcagcctcttctgtgcctggtgtcttcaagtcatgagcctctcaaattcacgtgctcagatatctcgtttgaggagatgtatagtgagcaccatgtgattcagggcgagggtgagagtgaaggtagggtaggggatgagggtgttgtctaaagcacagctctgctcatgtaactcctctgctcagaagccttcctatttatctcttgcctagtgagataagtccaaactttttatgccctctaggatacggcctaacctacctgcactgctttagggggttactacacttcagttattacctccgggccaactagggtacttgacacttcctaaacacaataggtgcatctcacttccattgctcttcctgtgcattgccacaccatcctgccctaaccacctcacgcagctggaattgcctttctcattgacctgtacctgtcaaagtcccgctaccctccaaagccccaaaaggtacttcctccattaagaattgactttattctcatcataacttttggtgcctccttgggctcagtcttggctttcttccatgtgttctagttattgatacacagaaccgtactataaactctgagacagtagtgatataaaattttgttttggctccaatggcacctagcacagtgcatggcatatagtaggtactctaccaatgcctgtgaaataaatacatcttacatttctgtaagtgtggaagaataccatcacattttaacagctttattgagatatcattcaaataccggacaattcacccatttaaaaggtacagttaggccaggagtggcggctcatgcctgacaccctgaactttgggaggccaaggtggggaatcacttgagcccaggagatcaagactatcctgggcaacatagtgagactccatctctacaaaaatcaacaaaattagccaggcatggtggtacacacctgtggtggccccagctacaagggaggctgaggtgggaggattgcttgagctgaggagtttgaagctgcagtgaattatgatcatgctactgtactccaatctgggtgacagagtgagactcctcaataaataaataaataaataacatacagttcaatggtttttagtattcatagaattgtgcaaccatcaccaaaatcaattttgaacatttccatcaccccaaaagaaactctgtagccattagtaggcattccctatttcctaccaa

SEQ ID NO: 1854 - DNA, 2200 bp, artificial
  synthetic oligo
tgccatctagaaggaccaaacttcagtgcttctgagggcttagaaggggaaaagagaaagcccaggcccctggtgctaggagcagagaagggtactttgtaagcgcttatgctgctggttctctggtaagggagaccactagccagtttgtgcgacatggggcaaataggaatcatgaggatctatttgctagatctgtgtataccacaccatccctacacccgcccctgtcatcatcatctacctccatggtcttctgtacagtgaagaatgactttcggcagatggagggccaattctccccatgaatccagcccttattccatctcacctaggcaggggacttgactcctttagtaaaccctcctgtcatgcctcaccaacccctctctactgattatccctaaactgttgaccaacaggctctcatctctcaaatcacaaagagagaagagaatctttgcttgtccctactcgctcctccagttctgctccatttttcttcccatttacattggaaagtctcaaaacagttgtctaccctatgctgtctctacttcaactccaattccctctgcaaccctgttccatcaaatccttccactttcctccactagcaccaccctaatctaaaccaccatcagctttgataggaactattgagaaagcctcctaactaatctccctatttaaatttttaatctcttctgaaccattctccatatagtagtcaaggtggtcttttaaaaatgtaaaccagatctggaatactactcagcaataaaaaagagcaagctatggaaacacccaacaacttggatgaatctcaagggactcaaaaccgagtgagaaaagccaatctcaaaatgaatattgtatgattcatttacaaaacattctcaaaatatcaaacttacagaaatggaggacggatcagtggttgccaatggtgaaagacttggggaactgaggagatagttattgctgttttataattacaatacaacaggtaagatccttgcaatgatgaaactgttttataattgaccatggtagtggaaagaggccacacgtgataaaattgtatagaacacacacataccagacgtgcacgcgcgtacacacacacacagtagaagtaaaactgaagaaatcaaaataagattggtagattgtattaatgtcaatattctagttatcttatagtgtagtcttgcattgggggaaattgggcaagggggaccccagatctctctgtattatttcttacaaatgcatgtgaatctacaatcatcccaaaagacaaaagtttagttaaaagaaatataagtcagaccgtgtcacgccttggggttaagccactcattcaatgccctcccattgattttggaatgaagtggcctgcccatggactgcacctgcccatggactagtatgcaatccacgatctggtccctgccaacctgtccagccttactttctggtactctccccagctttcctggcgccaatcatgatcaccaccttttagttccaaagcatcaagatttggtccctccttctgacttgttttctggaaagctttttcctggctctttcatatctttcagggttcagcttaaatgtcacctcctcctttcctaatcacactatttgtacttttcctgcacaggctttatccaaatttgattattttctcacttctttattgtctgtctcccccactagattacaagctcccagggcagggtgcgtactgtctgcagacaacgctgttatcaccagagcccggcactgagcttggcacatggcgagggctcagtaaactgaatgctgagtgaatgagacgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagg

SEQ ID NO: 1855 - DNA, 6500 bp, artificial
  synthetic oligo
gggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtag

SEQ ID NO: 1856 - DNA, 1950 bp, artificial
  synthetic oligo
aaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctcca

SEQ ID NO: 1857 - DNA, 5500 bp, artificial
  synthetic oligo
agtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatctt

SEQ ID NO: 1858 - DNA, 1550 bp, artificial
  synthetic oligo
ttttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacag

SEQ ID NO: 1859 - DNA, 2500 bp, artificial
  synthetic oligo
gctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaa

SEQ ID NO: 1860 - DNA, 1100 bp, artificial
  synthetic oligo
acaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtct

SEQ ID NO: 1861 - DNA, 2500 bp, artificial
  synthetic oligo
aatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaactttta

SEQ ID NO: 1862 - DNA, 2650 bp, artificial
  synthetic oligo
agaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatca

SEQ ID NO: 1863 - DNA, 1500 bp, artificial
  synthetic oligo
gtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacaggtgagtttcttttctccattatatttgccaggatgtgaaattgggcaaaaagaaaggaaagcttgtacttagcatttactggctactattctgcttttctcacactctgtaacgtggatgtgagattggaaaatctggtggcatttaaaataaaagttagtgtaagaatgttaaaatttctgtgttagcacggaggagaagttgaaattgcatgctttatggataatttattcttattgtttgctcggaagtatactgaacggggtttttatttttctccagtttattaagtaaagcaaattgttccaggtgtaaaggaaaaaaattcatgctttatacattagtgcagcctagtggtgcaatatagtcaacatgaaaaccaggataggtgtgaaattgaccacatatgtataactgtatattggaagagtggtaaaaagacacaggcatctaatttatttgaaattcatcaaattagctaatggcagaaaaacggtgaggttttcaactccctggtaacttagtgtaatgtcatcacgtaattctacttgttttctctgtaggcattcagtgacattatcatttccagagaaataaattaatcttggttgacttttagagctctgtggagagagcgtgtgagatcctcttgcagtcagggtgttcagattctgtgttaggatattttcagtccaagtactctgtttttctgtgttcctattgtagaataactgtaaaaacatgaaaaaatttgaggctccaaatgttaaaaatgatgctttacaaagcctgcaagattcctgtaagtaatcgatgtttggcagtaccagaaggaataacttcttcagattctagaatctgagaggaggaaaacctttccctgtgtcttttgatgatttttgctttgactggtcttatattctatttgagggcagactggcttaatgactgtagattttaaggtggatttgtttgaatgaggaggtatctctgtaccggcacaggacttctgattgcaactttgcctcgccctaaatctgtccactgatcaggttgggcaacgaattaacacttacaaacggggaagaaattaatcctctcctctttaccacataaacccttggaattctcttctaggaaggttgataactgttcactcatgaagaaaggaaaattaattcagtttaacatcagtcacttatacaaaagaagtcttttaggtaccttaagtgtattacactta

SEQ ID NO: 1864 - DNA, 2450 bp, artificial
  synthetic oligo
tgtaccctccctctcataaatatggacagaataaaaggaatgttgccaaaacatagttccatttgattaaaaatatttttctaacctctgggaaagggggagagaggattccatttaccccttgatcggtacgcagagaactgtgccttttttagagctagtccattcagttagtttaacaatggtgctcatgagactgaagttgcatatttaatacccatgtgaaccagttacctttgctctatttgtgaccacaggctatatattcacctaacttggctcatttctcttattaatagatgtaggtaggattatcttcacataaaaaggacagcacattttggatttacttctttgactatatggttagaattcctatagagtaaaaacaattttagttaccagcttggcaactttcatagacctcaaaacaatattctgacctagtcagcttctgctgatgcagtgaaagcaattttgtatagcgtctctttgtttttaattacagtaaattttggagaattccacggcattcttcgagttaactgcagacatcctagagtatctcgaaattagggggaaaggtatctctgaattagagttaatgagcccaagatcagaggttaccatgccaattgacttgctgtgttatatagtcacaggctgacttcctgcacatcccagccagttagcatacaaatgcatgttcaaagggaaatcagctgtaattaactgtaaatttctatgtaaatttataggataactttttaaaatctctcacagctaaatgttttgttttttttgttgttgttgttttttgtgttttttttttttttttttttttttttgctatgtttcttccccctatagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcaggtgtatggtgtccagatttttgttgtttgaaaagtgtgttgaaatcttaggagtgaaggatccctataagtaagtaaaatacaaaccattactttcttcaaagtacaaatagtaatgtcatcgggctttctaaataaaatgaagccccactaagtgcagaaagacaagtttatatatgccagtgaatcgtaagggaagtcaaatgggaaggaaggtgtaataaacaagatgaaacttaaaaatctcatttgttgtttaatcacatctgtgatgcttctaactcctcatatactgtgatttgcataaaattgtgtttgtgtttactgtgtggtgtaaatctagagatactttgtatgtgaaaaggggatcacaaaagagagaaagcatctcttaggctattttcttaaaaataaaccttcacagaatggctgtccttttccattaatctgtattccattgtagctgaatctgtgcagttgaaatgaaaatgttttggagtcagcgaatataaagcactgagtaaggatctggggcacagtgcttgccttactgggtcaacacttacaactgccatggattaataactgggctaagttatcattcacaaatattgttaggaacttgccttattcataggcagaataagtggtcatgtttatggtgtcatttgaggacctctgttgaaaaatctgcaaacctgccacagtgtctgaaattcttcctttacagaaattcgtttctttctggtaagcagtgccctctttctaaaaacatgcagaagtaccatatgaaatccctaacccctgggtgtgcaattgtgatcagatcatcttcctgcttgactttattaaacccaatgggtgcctaagtcctgtaagtgtatggcctaattaatctctgcccatggaaatcagatggaaagttctgattttctatcctgtgctcctacctgctaacatcattcacttgttaataattattgttttaaaaaaaaaaactcttgtcaatagacgtgtcagatttagacctgtggtttcagaaaaatttttggagcaaatttaaacatgtttggcactataggtaaatttgtatttaaaaaaaaa

SEQ ID NO: 1865 - DNA, 1250 bp, artificial
  synthetic oligo
agcctgggcaacagggcgagactccatctcaaaaaaaaaaaaaaaaaaagaaagaaagaataaaagaaagggggacacatgtgttttatttcctaccataaaatataatagatgattaataaacatttcagaaaaataaccactgttcccttcctcttattccagaaaacctttgcttatttaatagcttaagggtctacccatcctatgaagacacagttttactgtcccttgctatagactgatattcttttgttcggtttagttaagtttagtttttaaattaagcaaagaccagtagcattattagtgtctttggaggtttgcacagatgaacactgttcatgctgaaacatcctagttgacttgcagttatcttattacaaattagaatttttttattaaatgcaagtttctcttaaaatatattttaatatatttaaagaaatggtatttctttaaattagatttcataaagtgggtttgccgcatcataactcaaaatttatgtatttatgtaaaatttatgtaaacaaactttaaattattttaaattttgatagattttgccaaattgccctccagaaatgttgaattaatttacactcacaagagtatgagagtgttctattcccatatttttgttaatactaggtattactgaccttctaagcttttgccaatctaatagttgaaaatggtatcttattttaatttgttctttcctgataagaaagttaagtattgttttaaatgtttgttgactctgtatttcttcctttttgatttggttgttcatatcttttgctcagttttttgatttggttgttcatatcttttgctcagtttcctgttggcttatttgccttttttaatgattcatagaagttttttatattatggatagaaaccatatggtactgcaagtagattctctcagtctgctctttgtcttgtaactttatattggttttaggtacacagaagctcaccttgtgtcaactggtaaatctttctctttatgactcctgagcttcatgtcagagttggaaaggccttccccacttcaatattacatttattgtgatatatttcccatacatacatttctatatattattttagcagtttaatagtttaattttttatgtttacatctttaaccttatagtatttcctttcatgcgaagtatgagaaacaaatttgggtgtggagaattaagagctcagttttagacatattaaatttg

SEQ ID NO: 1866 - DNA, 1250 bp, artificial
  synthetic oligo
caggttcacagagcagcaggcatctcccataagcctccaggttttcagggggttctgtttcatggctgccatagagtttcctgtgccttctgatttcacctcgaccttctgtgaaacccctgcctgctgagggaagttgggcatggccctgttccttgcccaagccagccttcacaggccagatagagaggtggcttggttctccatcttccttcttggttgttgcattttccctataagaaccccacaaatcctttgactgtgaagatgttgtctccctcacagagtgtggtgcgggctaggcaaatatttgtccgctgattgagcaaatgaaggaaaaactgcctccctcaaagcctctcttatcaccactaggagtcaagtttctcataagctctgctgcctcaggggagggccccatgaaaggcttccagtcccacagaggttctcactggaggtgttatatgacatacatatggctttgaaaatggtgggaaatctttcaagtggcctttcattactgactgttagtatcctctcaaaccctacagaccagcaccaggccgtccagcccagctaggccattccaaggagaacaggctcccattcatgggctcccatggccgactcgcccacattctaagggctctctgttgagccaaatatgcaagtcccaaacacagagacccgtgtggctaggaaatgccgtcaaatttcctggcttctcttccccaatcagtgttgtgtttttatttacttatgtataatttatactggctgtacttcagaaaagaaaatacaagttgaaggtatctttgaattatctcccttttaaaaggacattgggaattttagaatcagtaactagagaagcttcagtaactatagtttgtagggggcatggtcctggtacgtatgccaccctgtgttcttcttgtcctgtccccagccccagtcctgaggccggcctcaggcctggcaacattgctctagggctgctgagagaaggtgagagggtatatacgtgggcctttagaggtctcaaaggatccagcctccttctctctcccctcccatctgccataatcagtaagggtagggaagaaatgctggctttttttaaaaaaaaaaagtgtaaatatctatgtgagatatagtcatgctagttgtttatggcccttgtaaatactgacagtttcctgtcttcttttcccgtaaggaagaggaatctatctgcacaaacatatatg

SEQ ID NO: 1867 - DNA, 1400 bp, artificial
  synthetic oligo
cctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctcacagagttaatagtttcgtggggaagacatgcccacccccaaagggaaaatacaaaatatttgcaagttatgataagtggagtgaggaaaacacatgaggtgttgaaatagggaaaaatgggggccaactttagataaagtgttcaaaggaggcctttctgaggaagtgacatgtgatcagggacctgaatgaagtgagagagccagctctgggaagaattagggcagagatggagggaggtggaggaaattgtccctgcaaaagcccgagatgtgtgtgaagaatggaaaaaaaaaaaagaccagggtgacaggagtggagtaagaaaggagagagtgtggtacaagagaagtctggagaggtaggcaggggccaggtggtgcaggggccttatgggtcacattgggagttgagatttcatattctaagcgacattgtgagccatggaaggattttacgtgtgatccaacttgcatctgataagatcacaaaagctgttctgtagaggacacattggagaaagggaagaatgaaaacaaagaggcaagaagcatgagaggatgatagcctggattaggtggcaacagcagagacaggggtatttgagatctatgtaggagggttagctcttaggacttggtaatggattaaataggaatggcaaagaaatgggaagaatccaggttatctcctaggtttcatgtttcaacaaatggataggagaatataactgttttggccatgtcaattctgaggtgcctataagacatccaagtggatataccttttaaacagttgtatatgtaagtgaagaaagtctgggtaaacatttgggatgtatattagtcct

SEQ ID NO: 1868 - DNA, 2850 bp, artificial
  synthetic oligo
caagtactgaagtgacccttaattaaggagtaaagaggatgtcgggagtggtcatcaggcaaattccccttgtcttaaatgtaaacttatatcctcttgtttttctctttgtggaaaagaagacaagattttaatcttcccctgggcaaaaacccgctttatagagtcagaattttaaaaaggggtttggaaagtatggtcaagaagggagagaaaactgagccagatcacctaagtgataggtctctgagaggaagggaatgtagaatttgaggttgcactcttactgagttttcttctttaaggacatgttgaaatttacttgtggattacagtaaacaagtacaagtttggcacccagctccctgggactctttcatcccatcatactacaaatgccagttaagttgtgcctcttcagttcctgttttccctttgacctgttcctccaggaatgtggacagatctttggtttgaagcttcagattcttcccctcagcttatatccctaggggcaaaacccaaactgcacccaaccatcatacccttgcacctaacagaaaactcatgaccctatcattataagcacaccgcttcaatcagctaacgtagcatagctaagccaacccattgaactacagaactgttttccctaaacccccaggcaggatttctcactatatgtaataaccaaactttgggctcccatcccagtattcagcaagattttgctttggctcagagtttctgaaaatgaaatcaataatctctaaaaagtagactttctgccagggccatctctgggcatggtgtccactcaactcatggttttcaaataatactatggtgctcatttgggcttcagaagttcacagtcctgattctctaaggaaggatctggtacgaaaaaacacttgggggaagtgtgtgggtgggtaacaactataagccagctggtagacattcctctaggtaggttgaatccttagaggctaagtcactgcctccaatattttctggaagtagttgtggaggagataaataatacatgaaatgagtgacagaggcagagttgaagcaaatacacaagaggagccagaaacactgagatgtgggtaacacccgtcacagacagtgggcgaagcagatttagatcctgtcataccattctgtagctggacaagttaattaacctccttgggcctcagtttcctaatctgtaacataggtataataatcagatagctaccttacagagctactgcaagattaaatgtgtttgttactatatagaaagtgattcaaacacagccaagcacatatttagcgatgtatattatgtatattgttgctgaattctagatgtttctagaatgttcaatcgactttggctactataccaagttagcaagtagccattattgacaaaacaattcaaaggcaggtaagaagagagccgcagtgagtaaaatttcccaattcaggtcattgattactgcctgcaaaatctattgttgacattgtttttatgttcttgttcttctacacacccacatttgaggggcaggggaaagtggggagtgtttccacatggaaattaaagattgagattgcttatttcgggaaaagcaaaaataaacaagatggaggtccaattggggccgtccccacctacttcctaggcagcttcataggaagctggcactggccctttgagcaatgcggggtcatctgagtctggttctgtcacacacctactcttttctattccaccatgtaacaaagaaccaagtcaccgttctttggttactgatcactttgatgaatgtcactcttcatttcctagtaaccgtttccttcctcattactaagccctaccaaccgaaggcctccaagctcttccactctgactcagaacaagaggcccgtatggcaagcccattgccctgaatcagagcttttccagtgtttgttgataggaagggaagaacgcaggtatggcaacagtgatcacaagatctacagctttggaaatctctcaaaccaatttctagtcactcgtcatctaaagattgttcctgaggggtaaagcaccttgatatgaaggcggaaacgatgacacagtggctgcgaagggttccttctctaccccacctcatcctctaccccactcggttcctcagtccacgttttggttcatccctctggatggagtgaaaaggatttgacaccaaattcgcaataaggcatgagtagtgtgggtgcaaccgctttaggtcatacttaaaatttgaagagaatctcagatagggtgagaaatctctaaaatggacacccaagccctgtgacctctcatctccaagcctcagggtgaaatgagctagtttaagtgaaacctttcttaattattccagtgaaaccatcttccccatcctggtcatctaaccaattatcccatttcattttcttcataatctttattactacctgaaagcatcttgttaatttatctatttgattattgtttgtctactctctcaataatgtttatgaggacagggactttgtccgtttgttcactcctgtatctttcagtgcctagaacagtgtctggaacacaataggtgcttgatgaatatttgtggtgtgaatgaaataataatgaactgaaatgatttttaagcaaggtctcctgaaaataaatcattcacccttccccatagcctttgacaattcagaacccaaacaattttttatggggcaaacagactaccctttgttctcccttaacattaactagcagatgtggcagtgataggaagtgtgggtcagttagtcaccatcatgcaa

SEQ ID NO: 1869 - DNA, 1200 bp, artificial
  synthetic oligo
gatagtggacttgcttgcctccactgatcttccttcacatgcagtgagtaggcagtatgcagttgcagtgatggtgagcatagactctgaagtcagactgctaaggttctaatcttggctctgccaacttgctagcacaataaccttaggcaagttacttcatctttgtgtacctccatttcctcatctgttgtggggattaagtgagttattatttgtaaaatacttagcacctggcacatagtaaatgctacgtaagttattatgctgcttcaagtaataaatgaacctgtgaataaaaattggcccatggataggccactaaatagacaaaacagaagcattaagttgaagtttaaaccttcaagttataacttccgtgcaccaagcatttctctttcctcttttcactgttgttgagatctggagtagttagactgtggcccaccagaagccacactctgtgaccatcaaaccccagaattgcccacctctgtcttctagaaactctgggtaggtgactcagcactcacttgctagttctcctgtagtaccctaagcctgaggctagcctgaaccacaacagtgggtgatcttggcagtgtctgttgggtggcccctctctctcctattaaaaatagcttcctaatctttgttagtgaactataggactgattcaagacaattttgtcatcaccaagttggctttttccatcccgctcctgattacatgtcctccctcctcttgccaggctacccgtgagctatatcctctatttttcaaagttagccgtagcaaaccacacctttggagcatctgaatacgaggtctataacatctctatttacgttctcagtagtaaaatgcctctatatcttttaaaaaaaatctctaagctaatgttttctatttttctcttaaagttaggagatttggagaactctatattagaaagctccaaagaataaaaaagggcatgattatctttttttcttgattcagaagagcacattctgtcaacaaaatattacttcatgcacgtggagcgttctcacgaaacattcatctgtccttatgaaatgttgaattttgcaaataaaaggtatatggtgcataattttaatattgaattgatggaatttcctccctgacatctgagttctcttgcttaacaaacacttctctcttcactaagcagc

SEQ ID NO: 1870 - DNA, 4250 bp, artificial
  synthetic oligo
acaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctagaagtcttcagggaaatgataatattaaccaaactggtcatttaggtcatgcaatttaactcaacatttatagggcacttacaaagtgcccaatatcaggctcataactggacaaaaagaaacttccacacagtctctgcccttagaagattgacacatctcattagggagcagggctttaacacaagaaataattaaagacagatacaatagttcagccagttgcttgaccaattcagaaaccataagaatcttactaagtgtgcagactttggagcccactaaaatccccagtgtatggagttgttcctaaaagcaagattcacggtatgtttaatgaagaccagtgtttttagcctgtgtcaatctatgcaaaatggaatcgagtattgatcaactgttaggagaatgagaccgatggaaacagccaattcaattactcagatattagaaaccaacttttccttcagtgggagagatgtcagaccattttatctttccttttatataatctatttttgcacagtctctattacacagttgtagaactggaccagatagttttgtgggcagtttttgcattattttagcctgacagtttttggttccatttcaggtgatcagaatcctcaaattgcggcacatgtcataagtgaggccagcagtaaaacaacatctggtaagtcacacagcatctgagcggtagccacccaaggggaaaggctgggatgccgaagtcatgttacctaatggttaaactcctcttttcccctgggacccaatttacaaacctacccctacacttctcctattcccttctttgtcttcaaagtgagttcaaatgcacagatgggacttagagggacaaaaggaggtggaatgcaatctggatgttctcattatgttcttgctcaatggctgattctaaatgatgaattactgggtggagggaccattgttctgacaacatagaagaaatggcatgtagtgacctcctgactgggagcatccctcctcctaacccatcttcactgtgtggaaatgggcctcatggggtatttcctgccatctgtcaatccctgtatgattaagctcagcctcactgaggccaacctcagggaaagtaaaggtaaaatcattctgtaaagatcaataggtcccaagacgttacattttccaatgaagtaacaacagacgacatattgtgatcttttcaactctgaacgattttatttccatatacgttctgccaccattctagcctttagatattttttcccaaatgtgcatcttgcgataactggtgccaaagaatatgtcgtatctgataaatggatggaaacatgcacgctaacataaagtctcccatcaacataaaggcaagagcgtcagaggagtctttgaaaaattctacagagtgctccggaatggagttctaagcagtgcatgtgtgtgtgcatatgtgtatgtgtgtgacagggagagaaagagagatggacagagagagaaaaaagacactgcttcatctctgaagtggcttgggcttctcagtaggcgtaacacatggacagttatcattatcatggatcatggtaccaaagtaagagcactgaatagggagtttttgaacactgggattcaaggaccatgaccactgcttgctgggtgaccttgagcaagaccctttacctatgcagcagttttctacttcacctactttacagggtggctttgagcatcaaatcagctaatgtggccgaaagtgatgctgtcgagtgctgtacaaccgtaaggtgacactacttagtttacttcaccatggcttagatgtcaaaagggtgacataaagcccctcactaataccagttagttacacaatatttaataattttgtcaagtaccccttctctcttctggatcagatgacaacaacagagaaatctcctagaagaatagcttcccactggtctttttttgcctgtatctaaacccttgatcttggatatatttcatagagctcagattctcccaaaaggcttgtaatggatatcagtcctacaatatcttacagtctgcatcacaataggtttccaggggatcagatgggaagacagtaacattccacccccaccccagtcccaaacctcttcttcctacctagccatgctgctaaaatcttgccctacatcccacagcaagtactaaaattaggtaaggacgtaccaaagtaaacttactgaactaaaagattgagaacctgccctttttttctcaataaaatggttcaaaagggcaaacattctaatgaagcattgtttctggagtggtctggagggcccggatctgtcaggcatttcaggatgcctccctattagtaaagggcgagtcttaccaggtgggatcttgtgccctgatagacctaagactatcgaataggaattattttttaaaaagctcaaggaagcaaacacatcagtactttcacttttcctcaaccctcacccccatcagtcagtctagctttctgtgggagctgagatttcaagtcgggtgcacacactactttgaacccactcaacatctcagccgagaaaatggcacactgttggtgggtactctggcttagccacaagaatactggtactttcaagttggtggcgcccactacaatgggagatcaaaacataccgtgaaatgagcacacagtttattttcatacttccttgcctaattttagtccttgctgggggaggcagatcaggtttgcaacagcatgatcaggtaggaagaaatggggtcttttctctgtgctgaggctgagctaggtagactgacaactctctgactttgtaaaattcaaggcaagcaaggtattcatggtaatattagcaaaaatttggtccgagtaatttggtatgtataatttatgatgtcaaattttgaaatcatttgtgccttcttaagttcaaggcaaattggctataagaactctaacgagagaaagaaactcactgtgatctcttactttatttaatcttcacaagtctctgaaatatgctccaatatgagccccgtgttgcagatgaggaactgaagctcatggagatttagagacttgcccaagcttaaatagagcctagattggaacatggctctgtctgactctgaagcccatggaaggggccttgagaatccatccctatacaaagccaatatccaacattaaactatattttttgtcagaatgtgaac

SEQ ID NO: 1871 - DNA, 6200 bp, artificial
  synthetic oligo
aatactgtttgactaaaaaaggcttatttgacaaaaacaaaccaaaagaaaacagaagtgttggcagagatctgaagaattcccaccagcatctcaattcagtcacataagggaagttgtaaaatagtggcatgatttctgccccactattattcaaacaggagacagaaaatatttgtgtcaattgacaatttacacttaatgacctcagttccagcccatgcataaacccaagattttataggaaaaaaagtcaactgtttagctctccagatgtgtgttatttctcaatcttttcccttggactagcttcccatttcatacatgtccttctacttttctggatccctttaggggatctagaaaccttcttgagattctaactgtaggaggccctttgttttagtttgtgtaacagtctttgcacccgactgtggggctgttcagttcagaatttggctcatatgttgatcagtccattaggttctgtttcttgggctccatgaatgatttggtccattgcctttctttcagttgaacacaagctgtagctctggcccatgagctcccgacccgagggccgaaaagtccttaagttcacaagcatcatcttccctttccttcagagctaaagttggcatgttgtagctctggaaaagatagaataccaactacaagtccaaaatggatagcccttgttgctttaagaaatgtagagcctaataatctttggggggaaaatttcagtcagaatcctcaagtccatgcttttacggaaagaccccagttcctgcctcttctatatatttatctaccttgtggtgaagagcatgtgtgtgcaacacctttgcctgaaatggtatggtttggcattaatgaattgtgggtccattgaaaagaaatctcctcttgtttctcgtgttatggacagttcaaggtttgccttagaactaacttcaaggaaaagtagcagaatcgtaggaagggacaatcttgccttcagtcccaccctctgttccgggcaggtctgggtggctatcttctttcgggggcttttccttgcagaagaacttcttcagcatgtcctggatttccttcttaatggtcttgtgcatgtagccatagacataggggtggatgcagcactgcaggaagaaaagccagatgattatggtgatcacccactggggtacctgggtttcgacatccacccacacggccaggactgctaaaaagcagtagggccccagggatagcacataggagaaaatgatgatgaagatcactttagcagctttgcactggtagcacctgggcagaggagggttgctgttgctgttacgacgactgggtgggaggctctccgggatgttcactgcctcgacgtcatcctcactgaaattgatgtcgtcttcaccaaactccatgtcatcttcacccaagtcaatgctgcactggttgacctctgtgcgacccttgtctgccttcatgctgttctcctcaactttggtgctgccttccttaccctccatgctgccgtcgctggccaccgtgctgctctctctgacctcctcgctgcccctggcctctacactactctcactggtccccgtgcttccttccttggccttcaggctgccgtccttggcttccattctgccctccttggccttgacctcaccttcatgctggcggcgaaactcactctcatcctggaactcctccttcttctctgctccctcttcatcctcattctccacacagtccttgactcgcacttccaagctgtgtctcttgacattgtacagcagagcatgctgcctccgggctgcacagaacaccacggagtagcaggcaatcatgacaatcagtggaatgacgatgaaggacaccacgctgagaatagtgtagctggggctggccccccagatcatggagcagagagcattgcgctcatcaaaggcagcctggccccagccgtagagtggaggagtgctctgcaggatggccacaatccaggtgccatagaggagcaggtaaccgcggcgctgggtcatcttggacgggtaggagagagggtggatgatggacaagtagcgatccactgacaccacgacaatggtgttgacgctggcgaaggcgaacaggtgggtgaggctaaccagggccgtgcagaagtggctgttgaggggccagaagagaggcacagaggtggccaccacccagggggccacgagcgaaatctgcagcaggtcggtgacgaggaggttaaagataaaacggttggtcacctgcagcagctgcggcttgcgctgcaacactagcgccagcactatgttgccgacgaaagaggcggcgaggaagataaccagcacggttgagcggatgatgccgtgggccaggctgatgggcattttggagaggggcatgcacgtgtggctgctgttactctcgcgcgtgctgttggtgcaggtggacgtcatggcaacagccagagggcgtgagacaggttgcaggctcagtgccggcaccggtgggtggcaaaggggtgcacagaccgcactcagtgcctatgctggtgacaaaagaaacacgcaggcagagttagtcacccgtcaaggggagaagcctccgcgcccagcaaggacgctgcaggaccccctaccccgggtttccgcacggctccatccccagtgcgggcagcttctatggctcctttccggactctccagatctgtctgcctgtctctctccagggctctgatttcctctcatctgtttctcctgctggcgcgtgcgtgcgtgcgctttctctgcttgtctctcacactgtctctggctccggggagttttggtcgctagcgctagcgcatgcgcgtgcgctctctgtttctgtctgtttacgaccgtcagtttctgtctcttctccagtgtctctcgctagcgcactttttttctttatctctcgggttgtgtgtctgtatgtgtctcaccgtttcctgattctttctcatccttgtctctcacttatgtctgtctctgtttctccgtctctcgatagcacgtgcacgctgtctctttcctgttactctcatttatctcttccactctgtttgtcactcagtctctctgtgtgtgtctctttcgctagcgcactttctctgcagggcttgcgctctcgctccctatctttctcacagtcttgcccgtctctccctcagtctctttctgatccattctgtctctctgtgtctctgcctgtcactgtgtcgctcgctagttcatgtgtgtctccgtctttccctagtgctctcttgtctctccatttctctctcagtctatttccccagcagttcatctttgtgggtccctagcgcacctgttcaatgtcgttcgctgtgtctctgcccgtctccgtgtctctccaactctcttgtttctgcgtctccctcgggttctctgggtgtctccttctgtctctcactggcacgtgtgcgcttgctctgtctttctcggaccctcttgtctctgtgtctctccgtgtggtttctgtctctccctgcctaagttctctctgcattactctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagccttgtgagataagtaccgctattatcttcattttatagagacagaagcagaagccaagaaagattaccctacttgcctaagttcaagtaaatattgcacacgttctattagccaagacattctggtctctcctaaacacatactgggtatttgttgtatatcaggactgaggaggccccctcttccctgcccccagaaggtagggaaggtgacccagaccagggatcatttgcattagatttccaagggattaggaggtgttttctaggcagggcacaaggggaaatgtgttctgtaaaaagaagatgcatggggtaaaactagggctgcaagagagacttgagttccaaaggctgggaaaacaggctgcagcatggtgagtgccaggaggttagctggttaaactgggtagagacaaatcctgaggggtcttgaatgccagtctgcagacttcggactttaccctgagatccctggaggtcgtcggagagtcgttttattatgaaagacttcaagcatacacaaacgtaatgagaataataaaataatcctccatgttcctattacccagccttcacaagggtaaataatttgccattcttgttcattggtgggttttaggtagggcgatattctaaaatcagggctggtgttggatggagaaagctgaagggaggctgtggcaggagacaaagagggtcttgacaggtccaacagagcggggcaagcag

SEQ ID NO: 1872 - DNA, 1450 bp, artificial
  synthetic oligo
tatcttccaggcgggcatacctccggacatcgccagctctgggtgattgtgaggtgccgcacgatggggtctgacggcaattgctcatcctcagcagtttaaaaatgacatttggttgagttgccgtaggtgttatggatgcttccccctccttcatttgcgttttgctgagttgtcgtcagatattatgtggtcggatgttcccgagaagtgcaagcccctccccgtgggccgcccaggggtggcccgcgggcggtgcgggcgactagcggaggttggagtgggcttgtagactcgctcttactcccaccctctgggaggcccctaaccccgccctttccctgctcgcggcgaaggcaaactgcgcgcacggcgccctctagtgcccaggagctgtcactgcgcgggtgcccgcggccccagctctccccgccccaccaagggtgtttgtgaagatccctcggcacggccgcataccccaatcttcattcctgggtgtcctgaccatcccccacagacccataagacgcagatccgagaccgcttcttgtttgtttatttatttatttagctaaaagtttactaaaaccggggggctctgtcggttcttgactttgcggcacctgcccccgaaggcgccgtctcctccagagaacagcgcctgcgataggattcagcaggggtcacccacacccctaactcaactcgaggtgcgagtccccatctcgcagcgccctcgcgactgtcatctgctgccttcgctaccatttttgtttggagaagcactgagaggagaaaggggcagtctactcctcactaaacgtaacccggtggccccaggcgcagccccatctcctcggatgccaggaagatgcccgcgtgccgctcgcgcgcaggcgctgtcgttttagaaaacccggtgtttggtcagacttagacatcgatttctaccaccctcgcagcttctgtctattgcttggcaaactggtagagtaaactggatttaacaaagggaaaataaatttgccagggcctgctgtgccgaaatgtgggttgctatcagcacgggcgcttaatgaggactgaattatcattaatacgtggatgaaatttatagtgctcattaatacttctgaaagacaacattccaggcgttgtctacctcttccctctgcaaatgtggatgggattcaaaacgtgtgtctggctcgcgagcgcactttgaaaggcaatttaattatcattcatttctgaatttggccatggggcttgtaacactggccttcatttccccccttctctgtgttcttaatgacaccaaggtttctctctgttgccacctaatgaattttactattgaatagcagaggctgcgagaacatgtattcatcccttccaatgttaaaatgttttaaagtacaaagtaagaagaattattattgcttgaatt

SEQ ID NO: 1873 - DNA, 4100 bp, artificial
  synthetic oligo
ccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgc

SEQ ID NO: 1874 - DNA, 4450 bp, artificial
  synthetic oligo
acgtagaccttccggggggagcctctgggtccccaccccactcctgaaaagaggccctggcctttgggatcgctgggctttacggactagaggtggggtaggtggggaggctgcactgccaggaccccagcaacttccaactgctgctggggacaacttactgcatgggcaaggctctggggacagaggaggtggtaggagagaaagtccgtttagaggaacagatgggctcaaaagaagttttcagacaaacctgtggaatgggggtaaagaggacaagcaggactccatgcatttcccaataaaagtagggtgagtccaagtctacggcaggagaccagttactgtgaagaatgtacagaacgtacagaatgtgcagaaccaacttgtaggagcctaggtgagactggaagccagctccagattccgatttgaatgatgtgtgacgctgtctcttccctcaggtagacagcatacaccttccgagctccctggcctcggccataattgccagccgctcctctgggttgggcctaagagcagccggctcccggaccgcggtggcgcaggcgggctctgcggcgagccggggagagcgcggctgccggagaaatatgctaatggcggcctctccggcacagtcctggatttggtctaggctttctggcttggccctggaactctcagcaaggacgggtcgagtacccaagccgtggagaaagcccaggaagggcacgtgctaggatctcacacctgacccgcggcagaggctgctcgggggtcagacctggcgctggcgtttctttctgctcttccgcctgtgttcgggtagccacaggcttcccagaggcctggagctggtcgcccatatgcgcgtgagtgctcatctcccagtcacaactgttggcaaaccgactactacagccgtcgagttcacacttgaactggtttacgcctggaaatagaaacttcaacgctctcaccccatcctacggagccgctaagcaatatataagaagggtaataacgtattcgctggagacaacaaataattccccacgttaaaataactgattgttttcagaaatttattttttacataaatatataaaacgaattcacgccgatccccattgcacccagcatttgagaaattaccgagtgatctgtagctcagagacagacaccggcgtggtccgagtgttacagcaaagtctcagcacctgtaaacttgcaacactgagacaaatgaaacccctcgcgccggcatccgctggcgcacaagctcctgcggcccccgtcgcttgctctggaactcctagctctgggaccacttccctacccgcagatttcgccaaaggctattgcaaaaacccaccctttgtctcataaaactacaaagagccacacagccagaggcaggcttttcggcaggctcctcagccttccccggagataccggcgagtctcgggtgcaccaggcaggagcaagttttctccttactgggattggggtgcgcctctcttccacccggtggtcctgtgcgcaggggtgtgctgaggagactgtaaaaaagctactaaccggcagggcctgctctccacggaacaaggccacagggagaagaagaggggagcccctgggaacagaagaacacctggcagggctggggtggggattgcagctagtccatgacccaactacggtgtgaacctggacccggaagctgggctgtaagcggagctaaggtttcttctcctccctatagggctagcctaaagatgtagtcattacggaagccaccttttgggaatgaatcgggatgggcagcaatttccgaggggtgtggggtggggaagagagagcgagagcgagcctgagggtaggcgggggctagcaaaaattcggagagctgagcactcccctcgccttcggctcccataaggacccacccctgtcaacaaatggtaagtcctttggggaatgctagagaaagaaactggcaggtcagagataaaggtgcgcctgggcgctggggatggagtgggagggcagggaagggttagtggtccttgtcccgtggaaatcgtacatgtgctcggaaggcttgtgtaattggaggccaaggggtgcttgtattagtgtgcatgagaaagagacagagagacacatgagaccaagaagctgaatggacgtgtaagtcgcactggacgacaatttcaaaatgcagagtttggcttattatgcaaacgaataaatctcacacagctttcacttgttcatcccctgcagaccgtagcggtttgcactctcctggttcaagttcgaagtggaacgggaaacaaaagcaggcaacgattccagcgcggcctgaaagacggaccacaaagcctcctccctcgtctctcctccgggagccgggaagccaatgtgacgatcaaaagcttccacatcgccccggcggggcgcgccctcagccctgtcggggaggtggggaatctgcagaaatctaggtctggaggctcctgccaatttttccttgaatcagaggaaggcgcgggttatagggccctttctcccgtgggttcaccgccgggagaaccaagtttgtatttggccattcagtgccacccgcgcctgccctaaggctccgaggtccattaggccagtaatcgtcccaactggggaaatgaatggttggcctggcctgggggcaccggttccttcctgcctgtgggcgtctctagctgagcctctggttcagggctctgagctctgccaaggcccatgtcatttagtggcccctccggggtggggacggcctctctcggaagggtggggaagtccctcgaaactatgggcagggagagagaagagagaagagacccactgcttgttcaaaaccaagccctaacctaagccaggtctaggcaagacagagacacctcttacataggagtcaccggccctaactcctccccgccatagctctggagaggaggtgcatcttaaagatgatcctcggctcctggtggttgaggtgcagcgtcaggttgcacctggtcttgcctttcccggcgggcgggccaagagggcggctattgagcctcgcggatccaggccctagaggccaggaagaggagatcgcgcggccttgataagccggatcaccagcagtgaccctcgttgacgtcggggtaaccccgctaagtgaccgccacgtgagaaagtctgggccgctcacaatgcgccggcgcctcgttagggccgggcgggcgctcggggagccaggccagcagtgtccgcggcctcatcattcattcccctggacgtgctggtaaaaatgcatcaaaataggctgcggagcgcggtataaaagcacagcgggatgagctgctttccaaaaaggatctcggtgattggaccgagctcggcgtgattgacaagagcttagtttggtaaagggaagacacgcaagctttcacagcaggagcccttttctaaaatatatcacactagcctttgaaaagcgccgcacactataaggaaatagcgtttcacggcttgctttatggtgcgatgacatttctttaaaacacagcgaagatcaaaaaaaggagagagagaaataaaatgtgttgcaaacacaatgttttaattagtttattctgcgcgttgcttttaactgtcgtatacattgcgggttttcctttaattaaacagtccctctcgagcggtggcaggcgaggaaggcgaggcgctgcgccctttcgtttccttttggaaaaacgagaaggttggctggccccagagcccagctcgcaggctcctgtgccctcgcggccaggataggcagactgaggcgttggggcttcggaaagcggcgggacccgagcgccccacggaggcggagaaggaggggacgaggaggaaaggaaggggaggaggttctcccccggggaaccgaatgggaccaaggcagtgcgagtagctcgggcatggcgccaacctccaatcccctccccacgagctccagccagcagccggtgtccccccgcccccctaacccgcaccacctttccaagccctctctggtcgccagggtggtggggagcgataggcaccaggatgagccctgcggttctggccgtctcctcggctttcgggctccgatttccagctacttagccctctttggatcccaaagtagcggattctctgattcctgacccacaggaagaagagactacgcaagcatccgctcgccgaaagcgcgggcgccgcaggcgctgtcaaaagtggcgcctcaagaaagacgagagttgagctaatgggggaatgtgttgtggacctaagcctgttcttacacacacacaccccacactctcactcgtacttactacacgattacttcatggaaacctctgcagatttcggttctaccaacaa

SEQ ID NO: 1875 - DNA, 1850 bp, artificial
  synthetic oligo
acgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacacc

SEQ ID NO: 1876 - DNA, 2200 bp, artificial
  synthetic oligo
ttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatatttt

SEQ ID NO: 1877 - DNA, 3500 bp, artificial
  synthetic oligo
tttttttttttttttttttagctcccaagatgatgcagaaggtaaatgagaacaaaacgcaaagtactttccactgtactgcacggaatgtttcagcaagatttttttttgtagtctccaaaaactatttaaattgctcttaagaccggaactagtttgtgccccatcaccacattgcccttaatgatttattacatctagaaaataatatagaccagctcaaaacaaaacaagcaagaccaaagagttctgtgtgatgaagatgcacagaccacagccttgaattaattcctctggtctaactgaagatgtttgcatggcctcctttagatttgtggatagcactgaatagggaggtatatttggaacatgtgttgtggctatctgatttgtgggaaattgccaccaagtctattttttgaataccaaaacttccactgcaaggcttagaacctactaagtcaaaactaccttgggtgcacaggaaggcgcgcacatcaattgcagcaccttgcagacttctctgaaaagctctggctgaacttcaggtctcagagttgcactctgttctgaggcagccccggtgccccagtcagaatggccccataggaacgcagccccacagcctgcagcatcctccctgctacatcaaccccaaagctgggcaacttcagcttgctaaatgtgagtgtatcacgactggcaagtgaccaagtccatgttaccccacttactccccttaatcaaaccatggcagcggccgtaaagactttgtgagttacttgtctttgcttttgtttgtccttccagacaaacaagagcttttgcctttgtagggaagcaacaagctcatggaccaagatgaaaagatgcgcttttctgggtgcaaagcccaagtcagtggcagcagctgtttccctacaactcctcccccacctgccctgccacggccctgctgctggtttccgaacctgagtgcctttttgacttggtttcctccacatgcgttatgggaaaaacaaaaacaaaaaaaaattgctttttcaacttcagggaatattacaagggaagtgcactcctcaaagaggctgggttctggtgtgtgagatgcagtgtgggaagatacactctattcccacttctccggggacgcaccaaagtgggtgagaaggggataggagacctgaaccagcaatggcagagacagtttcatactgcttcctgcactttcccacggtcctcctgcgggaccagagctcctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccgcaggacactgaggtccacggcgccgaagcggcagcttggggcatgtgcctggccgcccgccttggcgaacccaggtagggccgggcccctgccgctgccatcctcacgctggagagccgggcagggccgctactccagccagcagctgcccagctctgacccgcgcgccgccgctgggcactcaggcactgccggaggggtacagcccctggccccgctcagcccagctgcgccgcggccgccagtcctccggagcccccctagtagggacagaggcgcagaggcccgagagctccgcgcgcgcggagtccaggaacttgttaagagtttggggctctggcggagcgctctggcccccgccgctgcgagggcaactctccctgggtgcgcacacccacgcccccgcttagccaccggtggatgaaaggaggcgggggctgtggaggagggacgcaaggagctaaaagagagaatttctgcagagattcccattttcgagggacgaaaggccaacctaggctagcacttgtggtgggaggagacagcccagcctcgcactctcatggcaactcatgcaagtcttggcggtttcttagcattctggccagtatccacctgggcaaagactcggcgcaagggagttacactgtgtgagcacatgcaggtggccctgtcagggctgctgtctttgcccgaagagaatactagccctgaatagtctgagaggtcctgtgctgaagccgaaatatgtcctccgaggatgcaaacaaacacacagacatactctgatctcagtctttggatatgccaagtcccacgcccttcaggtcccaaacgccaagcctcctgtatagacacttgagctgccatctgccatgggcatgggagacttgacacgctttagagaggacacgagaaaacggaaaggcaagaggaggcaacccgtttaagaagccaaatggaaaatgaaaggagctagagctccttccttgccctgaacccaaagcactcagggactgggccgagggaagatggagctccgcagtgcctggaaggaaaagggtatgcaggacctgagggagccctgcttgtgaagcagtagctggctgaggagaggccaggggtgttagcatttaaaaaaaatgtgtgtctgaagctgagctaatgccatagggattcgccccaattttgctctaatgcttagaagtcctgatgtgaattgcaaatgccacatcccacttttttctttaatacttatccttttcaaaattttctggcaggagagtggattaatattatacaggccaatcattccaagtagatctcttatgaggaatcgccaatttatacctgaggaaagtggggataggcaagtgcaaaaggcagagtgagtaggggaggaacacacacacacacacacacacacacacacatgtcccccctacaagcacacacctcttcccctagccttgctttttcaacttctcggagttgatttacatatttttatctgaatgtgtaagctatttgaatgtgttaagtcaaccaggcagaatgtttgccagcctctctcttgaatatgtgcacagggtagaggagcaaatagttaaaatttccgcactactgtgggtagtatgacattaagaattctaccaatgtggcagttgttgtaaaataagttaaaaataaataagacacaaatgaggggtagtctataaaagtactaaataacaacctaggaagacatttttaaaatctaa

SEQ ID NO: 1878 - DNA, 1200 bp, artificial
  synthetic oligo
tataaactgttaatttgcaaagcttgatggtggaagaaagaaaaaaaggtcgtacaatagcttaggagggctgtcagcagggttaaacaacttttcttttccaaactagaggagacctacacgtgtttaaaagtagaaaaggaaagattctgtagaaaggagaagctaaagaagataattgaggaagctaggtgtgaaatgaggtagaaagggatgaactagagaacacacggctcagatttgagagaggaggagggggtgctcttccttaagactataaagaaggctgagagaagaaaaagcaaatcaagtggtcttaggtgaagaaaatgcatgtgagtatgtggtctctatcttttgagcaaagcttagtttttatgagaatgggcaatcgggaaaggggatggggtttcagaaggaatcaaagaatacagtttgaggttcagagttgaaaattagcaaaacttttggtactccacagccctatttcaaccactttctactgttttaaaataatagcagattgcaccatcctccagtcttcctgatcaattaattcaaattttatctcacccaggccaacatttaggtactaagactcaggcaggatgccatcaaaatccattaaaaatggctctcttcccagcagtgatagagatgcaaactctccttaacaatcaaatccaaccttgaattaattaatatctctgttggtgtctgttttatttttaagccatatagttcttactggctcaatttctagcattttgtaactccatttggcactcttcagcaagtatttagtctgccttacttgaaaacgtgtttgccattttggttccagttacttcttgtcacaggatataactgtgcacaaataacaccaacatgcaccaaaaatacaccaacatgcacaaaacagaacaaacgcaagagcttcttcagggcagggactatgccttatttatctttgtcccatttcccagggaagaacatggcacaatgttgaagctcagggaatgctgacaacaaatgaatggttatctatgtgctgttaaggagacagccctgaactgagatccaggagatgtcagttgtacctgttaactagagtttttcccagacaaatcacttatactcgctggaccctattttcccatgtgaaaatgaggggattggatgacattaaattgcttctga

SEQ ID NO: 1879 - DNA, 1850 bp, artificial
  synthetic oligo
cgccggccatgatgcccggctaatttttgtatttttagtagagacggggtttcaccatgttggccaggctcaaactcctgacctcaggtgatccacccgcctcggcctcccaaagtgctgggattacaggcatgagctaccgcacccggccaaaagctgactacttttactaaatctttacaaggagttcaggttggagggtttgctcatcggaatgcagtgtccctcagaggaactagcgcatattagcaccaccgtatgccaggcatggaattctcgcggcaatcccttgggtggaggccagctgggtaggcactatcattgcattatcatcttccttttacagatgagcctactgagatccagaacggctaagtatcatgtctaaattcccacaggtagtaagtggcaaagccaggaggttttgaaaataagctgggaatataaacggaaactataaaaaaagtttcattagaaaactatgtacaaagaaaaacaaattacaggaatacgattgcacacaaggcaatgtatatctatgtcttatgaagctaaataataaaaccaatacttatgaatgcaccaactaacttaaggaaacagcaccaccaatgccactgaatctccttgggtgctcctctctgaccctatcctcttgtctccttgccctgagatagccactatccttttttttcattcccttgattttcattactgttttattccaaaagtatgtgtgtttagttttgctttgttctgaaatgtatacaaatggaattttatacattttacgtttctcctgtgacttgctttattcactcaaagttgctcgtgagattcatccatgttgcttggtgtacttgcagtacttttttcaccaatgtatagaattctatacattcaattctattctattccaatttcaccaatgtatagatttcagtatagaattctggcacatgaacgtgccagaatgtactcattcattttcctgctgatagacacttggcttgtttccaggttttcactattacgtgcaatgctgctataaatgctcacgtacatgacttgtgggacatggtgtaaaagtttctctagggaatatacatggaaacaaatggctgcattatagtgaatacaaatgttcaacttttacaaaacaacctaatatccttttccaaagtggttgtattatatccgttcatgttcctactggaatgtatgagagtttccattggtttacatcttttgctaccatttgaagttcccagaactttaaattttggccaaactaatgaggttaaaatggcatgtcgttgtaggtttctaggagtttgtcaaatttgtaaaagttttcaaatttagtggcattaagttgcatcagttgatggggcagagagagagcattccaggttgggggagccacttgggaaagggttctaagtcaggtcagaggttggtgcatgtaaggaacagaaaaaaagccagcatagatgttgcataatgtgttcacctctgccttaggcagctaacctctcggtacctcacattttgcctgactttacctacggcatctgccagaccttacctgctagacctgactacttctgaacagctctcaagtattacaccatattatatggtgaaattgggctttaattttaaccagatggattcaaactagctcttatgtttttttatcagttagctctcacatttggatgaacttccagaagcttatttcaaaatatctttctgaccattgcaccatgggtccactgtcaaatcctccttgatcatcaaacaactttaaatttgctttttgaaatgtatttaggctctcatataca

SEQ ID NO: 1880 - DNA, 2150 bp, artificial
  synthetic oligo
aacaaaccagcacattctgcacatgtacctcggaacctaaaaaaataaaataaaaattgttttaaaaataaaaaggcattcattgtgcctcgagaacctgatagaaatttggcataggtaaaacagttgtttggcaaaatgattgcttagttgtctgaactcttcagcatgtaccagtggctttttagaactccgttttctcctcttgtgtagaccttcagtcattgaatgtcatttataatgaagcaattttaacagactttaactcacagatgcagaaacagagcttagcactgatgtgaagatcatattctcttagatatcgtttcttaacgtggaagctactctttcctccaaataaaacaattattgatctacttttttagtttaggtaacaaatggttaagttttgtaagttataagggagccaggcaactcctgaaacacatttttggtaacaagctactttaactggcttgtcatgcggaagactaaataaatgtgttttgtaaatgcacaaaacaacagtgttatctgtatgaatttgtttgtaaatataactcttgtaaattcttaagtggctttcgactcatctattattttaacggaaatataaaaaataagagatgcaggttgtcttgtttctaaaagagacttgttacatactgcggtgcaaattatatattggttcaattctatcttatgacaatagtgaggtcttcttgaaactgagagtactcctctttaagtactgataaatgctaataaatgctttactgaaaactttgttacatgaatacaaaaccttaattaccaagccaattattatgtttgccatgacttcaaagggatatttcttcagggtctttcctgtgaggggatgtttaataacttctttgggaccttctgcctgtgaaacagtatagacctatactttggtgcttttaaagagcaggatactagaaaagaaattggttgtttggggattgattgttgagatgtcagaaagagatgcttacaaagccaatatttggttaggtaatataataatgatagaagtcatttcaatgtaaccttagaatttcacaaagtattttcacatttatataatgtgaatatgaacaacattctggtaggtaatacataagacataaatataaaacagtaattcaaagagataaaatctacgggttttaaatatttctgtcttttgtaaatttgctgattattatcagcctcagtcctgcattgctgtatcttctctttctctttcaagtgtccaagagcttttcttgctattcctatgaaaccctaggttgtggctatatttagcagactatgaggaatactcttggcctcatccaattttttctccctgggtaattttaaggaaacaaatgatccgcaatcaagatatactaattgttctttccttgctgatggatgacatggattactttttaagattcaattcaacagggcatttatgaagtcaccactatgtgagtcttgtatgaaggttctggttctgatgcatatcattgttttcaaggagcttgcaatttgaccgacttgagggaaatatacatcattaaaaacatagcaaggaaaaaggaaataatcactctattagaagtttaagcaaacatagtcaagtgcagaggaaagcacagcagttatagaaggtttcacaaatgaaatattgtttgatcttgatctcaaaaattaccagactttaatagaactatatacacaaaagaaacatgactgtgggtggagggtatttggcaaatactgaagagttgataaggctaatcaaaacatctcattgaaaatatcaactataatatgaacaaagcattttcttcagaaataaatgattatgtcagaaacatattttttaaaataacattttcaaagctatgcttcatgcttttataatggtccaaaaagaaaacatctgcagacctataagaaaaaatctaatataaatttccctttaactgttcatctcaattccttccacataaaattcaataatcagttgcttctctgtgagtgtctccaggacttgtatgcacatgattgttgactggggtttatgggaagatttgcaagtatcctatcatgtggcttttctgggttgatca

SEQ ID NO: 1881 - DNA, 7750 bp, artificial
  synthetic oligo
agagagagagagagacacggaaggaaggaaggaaggaaggaaggaaggaaggaaggaaggaaggaagcaagcaagcacagagagagagagagatggaaggaaggaaggaaagaaggaagcaaagagagagagagagaaaaaaggagaggaaaggaaagtaggaaggaagggaaacaagaaagaaaaagtgggggcatagtgggggaatcaaggaaggaagtaaaaaaccccaccagatccagtacagacataaaagccaaacataaatcctgtccaccagacactaatgagcaccctctaaactgcaaacccgtaggactccttggtagtatgtgtcacctccacaactatcaagggcactttttaacccaatgacaaagccagacgtgatctcatctgtatgtaaagtgaagatcctgttatataaaggcaccgccatgacaaggaatggccagtaacacagagtcattgtgaaccctaggccggcaatgctagcagcacaattagcactcagcgagcaactccaggtaatttttttttttttttttttttagacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggcttcctaaaacccagcacctgctcgagtatctcctgggcacttttccagggaggcgtgttaggctgaagtctctatcatgcaagccaaagatgtcggaggggggtactggactgcaaagaaagaaaaaggatggagaccatgaagacttttttgtgcagtcagaaaattactcattttctgacacatttattgaccagcacatattctgcccaaatgctgccctctatgtgctctggtctgcgtagtctgggtacgcctggggcccatcgctagctggcatgtactgtgacgtgcggtggctgtgggggcaatggtggtgcagagctgggagatgggggaacatgaccatggaggcagcaggctgtgcagccccagcagccactagggtcaccggtacccagagatggcaaaagggcagcatgccaggtgcaggaagtcctgtggtgtccatggcaagggtactacgggacgctgtgggaagggccaccacaggcccgtaagaattcatctgagtgggagatccagggacatagaggaagggcagcgctgcaggcccagggacagcggccaccggagtgacgtgagcctggctgccctctgaccactcgccggccggctgggtcactggactgttgtcactcgccacggcggaatcaggcaccatcacaggagttgctggtggagcagagccactcctgatttgggtgttgggaccggccggttcccggtgttgcggtgtgacctggtcattctcattcggagacgtgtgatcttgttgctcagtgtctgctggtgccagacaggatccagcagcttctggcttgtcctcctcctgatgtcttggtgcagacttgacacccactcttctcttcatcctcacgaggaggtgaggggagtctctttgaaagtaaggatggcagtagaactctaactataagtcaaagtttaaataaacaaaaggaaactgcaagtcacaaggatggactacaactaccaaccatctacgcccctgtgcaagagaactctactggcccaggaggcctttctggaaaaggtcccagtccccaaaggaagctggggactcgcgttcacatcgtcaaggtttaccaagttgtggcgggcctttccgtcttggaaaaagcctcaaaatggcagattagggtgtccatggccggcggaaagggtctttgaagttgcagaccaggagggaagaagattctgggcctcccccatgcagtgtcagctggcaacagaatgcaccccggctgggttggaggccctgggtactggctcttccacaccaggggcccacctaccaagggcagcaggagcatctgcacctcctgcgccaggcgcccttcagtgcttccacttgagcacctctccagacaccagctagggtgacagtggtacaaataccagactcccctggcctgctcacctcacagggtaatgtgctgtggagtcagggggacacagcaaccgccagatgacatggctggccccggggaggacgacacgcagatacggctacttggcacctgtgatattttacacactcgagaggggcccgcaccatcctcagccctctccccacattcactcttagttcatgtcacctccacccagagggggacacaggcccacagcgatggccccacaccctgcctgaggtcgcccacttcccaggaggcagtcctgggacttccacccgaccaggccccagagcccaccgacttaacccctccagaggcttgtcgttcattaccttattcaagatggagaccagcctttttgcggagaaaatgcgggtgaaggtcctgaaagtgcattgacgccgttttcggaagccatacaagtttagctggcggaagaagctctttatcgaagttgtggcaaacactttgtgtgcgacgtcccttttgagaatctccttttcaaagagtttttgattgatcactctacaagccccactgtcatcccaccagatggacgaaaactggttgctgctgaccagtctccacagtttctgtggaaaggggagggagaggagattatcttctccctggggcgggacgtcaccgtcagggtgcggccttctgaacgaagcttcctcggccagaggttggaaagcgatttcttctgtcagcagcctcaagttagggctcccagtggaccccgggtcgtcccaggcaggggaaggatctgctgggtgaaggtaggtctctgactgcaactggggagggaaaggcaccctttccaagccatgatcctgtcctctcgaatttctttcttcacagcgagccatactcaatgatcgcttgtcctccatctggcaaacttgctagtgcagtgtggccagcagcaccccttggcagtcatgtaaccagccccatgacatcataaaggggctctgactgccggggggtggcatctccacccccagcaagttgtgtaataaagggccaaggcagacaagtagctgcccatctgcatgtgcacattctggtcctcacagtcatttcaatgggaaagatgacactagtgcacaagagtgccgaggggccctgccacaccgtagatgcagacctggagcggtccccttgtcctagagctcctgagccaggcacaactacagcaaagccctggctcaggaaggtcagagctcaccgtctgagtcatgggcccacagaccccagcacatgactgacactcggaagcacagaacaaagggtaggacggtgcccatgggtcaggctgtagccacgccaccctttccaccctgtcctagccagaggcagcaatgtgctccatacagatcctcctaacacacccacactgtcggtccccagcacgcagatgcccgacagccccttaggcaaatggcttagctgactgccccaccacacgccgtcgccatgcagtccagtggggagtcggaggcagcctccttcctgcctctcctcggcctgcacgtgtccccccaccaggcagagacccttctacaccccgggtgtctgcggtcacatcgcggtggggcatgcagctgttggccttcgagcatgttttgttttccttggccagtgtctccagagaaacgcacgtgggtttgtgtccagcggtccatctctgcaacagttgttcctttgggattggatgctaggaggtcacgggagaggtgtccatccaaagcagtgtctgtgtcacacactgtccccacacacagggccacctctgcacagactcccccgactcgattctgggcacagagctcagtgaccttccagagactgccacgaaccggtgatgcctccacgcttgagacatcctgaccgcagggcccaaggcgcactggctcagggggtgacagtgaggggtctgcaaacagactgctgatgctcaacccggccgctgccgagctgtgtgacttgggcacgtcacttaacctctctcggcctctgtctcctcccggggataagagtagtagcacctgcttcccggggctgtgaggatccagtgggacgtataggaactagcgaggcaccggcagttgggtcagagctactgttgtcacttcacaaggcattttcttcaacagcaagtcggaaatctcatgagcctaaggcagaatccacctgtggcctctggttacaacccacaggactgaaaatccttccagccacagcaactggtgaatttcctggtcaattgccacaagtcatgagctgaaccccacttgagtttcagttcaggcagaactctagagacgactagggccagctagacagcgactgcagagccttttgttgcagcgtgagcagtcctcagctgttgacatcactggggagcaaacgaggaccaggagcggtgaaaggacagtgtctgctgcagattgtcgtagcacccaaggaacactccagaaagcctcctaagcagtaacaagtgtggcaaggtgtagcccagccaacagtggcatctgcgaggcgtcccctccttcctcccactaccccgtataccctgggacctgtgcactgaaggactcatcctaaaggctgtgcccctgcagccgccagcctcactcactggctgcctgtgccagctagagatttctttcctctgaggctggctgagaggaccactccagtttcctggcccatccagcaaagaagatacacatcatgcacgtgtaaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttcccacgcatagtcgtgacccgcgtggccgtttctgctctcagcaacattctctagtgttccggcttcaagcagcgcttgtcaggtttgaagctagccactattctgagaacgtcagaaaagcatggaccatctcttgcttggtgttgccgttctggcagtagcagctactacgtacctgcacgagttccagggcagaagtggcaatgtcccatgaaggcgtggcaccccacggggggggggggagtgtgccacgggcgtccacttctgcagcagaaggcatgtgcctacagcacaagcttgtaaaaaaatacttgaacagaatatgctgtacagaactaggggttaacaccgcatatgaagatgctaaaacatttgtataaatactctgtatacaagcatggagtcactcccgtagaaagggctcatccgtgaggctatgaaaaactgctgtcagcatgcccaaagagaaactacttccacagtaggaacagaaaaaaggactgtgctgtgtctaaacacgtggtgcatcagagacatagttacagttcctactgactgccccagccacgacctgggagtgctgaggacctgggagtgctcagcgagctgcaggaggtcagccctgtggagaaatacatttctaaacaatacttttgattgggatttcagcaccgtatagacagatgttccttctgggggcctggcaagcagccatctcccagtgggtctgacggggaagaggggtacctggagcccctcccagacagacggtaatcccacccctgttctcacactcttcctggcatccgcatctgctggcacacacccccgtcacctgccacttccgcgtcccgtcgtggtgagtggctgataggcgctggatgcaaacaaggcatgagatggacgtacctggagacccagctccagtactggttctggtctgcggggtgaacgagggggcagaggaaggcggagagagtgcgtcccagtccacttaagctctgtccccggaagtggcatctaatctggcatttcgatatttaatttgggaggtgggagcacatacttcccagggctctgggtaatgaccaccctggccttctttcgaaacatgggtgcgattttagggggctccggaactggggtctcttcggtttcttcattatcttcgtgatggagatcataggaaatgtttccatattctcgtagaaatgggaagatttcaagcagaaactgacagaaatctttgcggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaagtttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggtcctggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagaggccaacagggacctaggatgaatcccaggtttgggtgggagatgtggattttccatcaaaccctcccgggcctggg

SEQ ID NO: 1882 - DNA, 1450 bp, artificial
  synthetic oligo
ctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcgcacagccgttggcaggatgcagaagaggtctgtcaccctgcaaaactctccgtgctgtcccttcactatcacaccgtccccaccattagccccggcaaacactgatctgttctctgtcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagttctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtcttcatttcattttaattttgaggaagtccaaatttatgatttctctctcgtatggaccatattaacagtgccatttctaagtactctctgcctaattgcaaaccccaaagattctgtcctatgttatttcctaacagatctatagttttacattttcttttagatctatgatttgagttggcatacgaattttacttctcctgaccagttc

SEQ ID NO: 1883 - DNA, 2200 bp, artificial
  synthetic oligo
gagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagagcacatacaaagtcacaatgactcacaagttaaaatgtcaccatccctagggagactgcaccctcaacatacaaatactcccctaaaacttcctttcatcctcaacaagcagccaaggcataggtccccagagttggcccccccgcagtacagcactgcacagtactgtaaggcatcttaagtgtacaagcccttcttcaccccatgctgagaccgccagcatctaaagcacctagcataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtccc

SEQ ID NO: 1884 - DNA, 1700 bp, artificial
  synthetic oligo
actggagctactactgtttcaatgaaaccagactactggcacccgtggtctcaggtgccacctgacattttcacactggaataggggcaaaaatttaaacatttccttctacacatcctgtcatcttccttctatgccagctatggactctccctaacttccttgacactctggccatttcgattacaggtaccagttaaacacagtcttcattctcccccagggctttgctttgttgtttagattttgttgttgatactatttgtttttttattttattttattctttcttctatagttttccaggattgattttggtagttgagggcagaagtccaagcctgacattcatcttggcagctaaattttaagcattatatctgtaaatcttgaataagaaaaattgatatcttttcaatagtctgttccctattaagggatatagaatacggctctgtttatctgggaactttttgacctaactctatcagtacttgcatagttgtttccataaagatcttgtatgctttgtctgtctccattggataatttctagattttgttgccattgtgaatggggtattttctattacttgttctgaatagttatttatttgggttgcaaggattttgattttactgtagtaatcttctgtatactatttttctgaagtctgttatttgactattccatctgcacaattctttgaattttctagataatcatattgtcgtaccaaatattaaatctgttcaatatttatactgattttttttgatatccacctctctggccttatgttacagtgtaatttccaaagatagaggttatagcatagtcctatgacaataattcttctgacatttcatatttgggtatgctggccagtgatcgtaggaaaagctaatttccttctaacctcattttgctaaaacttttgaccatgacctcttgtagaatttcctccagaatcttttctgtacctattatacctattaaagtgatcactttttaaaatcttaattcgataacgtaggaaatcacaactgaaaattgttttatattaaatcatgtttttgttccttggacacaatccgttaattcacttctatgttgaatatgctactaatttaattaatatatttgcctctgtgtgagtgaagtttggctcaagtgttttcacggtgctgtcctcctctggtacctgaatgaagaatggttagcttgggaaaataatttgaataattgcccaacttttcgtatgccttggaagagtttacttaaggtggctttgagctttacctgataacaatgtagaattggcctccgaagctgccttgtccacatttgaggatggcttgagcttagattagtttcactttttattgtttggttaaagatttgaatttctttttgtatcaatttgttcatgtacttattttcctaaaatattatccatttcacttaggatttcaaattaaatatcatatttatttcaaaaatattttcattacaagcattttcaaatacacctaataatagggtaaatactataattaatctaatataccagactttcagtatcaataatcttcaactcatggccaatctggttctagttatacccctacctactccgcatagcagaaactgaaataatgtggagcaaatccaagacaccatgtgatctcatctccaa

SEQ ID NO: 1885 - DNA, 1550 bp, artificial
  synthetic oligo
gcacctgaaaaagtacaaatgtcctctcctaggaaataccttgggcacatactaacttcccggtcagcaaaacctcaaaaggttaaattaaatactagcaacttacacaccttaaataatgaccagaaattactaggcaatattaactggcttcgccccaccttaggcataactacttataagttccaaaacctgttttctatattaaaaggcaatgctgctctagactcttctaggcacttaactcctgcagcataaagggaaattgagggagtagagcaagctatttctcacaggcaactagattgcatagctccatgatattcagttcagttgtttgtttttcccactaaacattccccaagaggattaataggacagatgggcccagggctgcactttctagaatgggttttttgcccacataataggactaaaacactctctctatatatccagctaattagtaaagtcatccattcaggccgcagacaatgcaataggttgctaggttatgatcctgatgtcatcagaattcctttgagtaaaaagcaattcgaagcagtattgcctttatctttaggcctgcaaacagcactctctgattacacaggccatgtagagcatgcccttcctgctgataaatgacttcagttcttatctcatacttctgtggttttgcctgcaaaaatagctcactcccccatacctaacattttaacactgtttaccgatggctctggtaaacatggaaaagcggctatttggtggagaccgcataattccctcattcattctggatttactagcactcagagagctgaagttggagccttaatattggccttcgagaattttttcgctcaacccatcaatattgttagtgaccctgcttactctatttatttactgcagaaccttgaaacaaccctcattaagtccactctggagcccacactgtgtgcactttttgttcgacttcagcaattgctagatcaacgtacacatcctatttttatcacatatattcgagcccacagctcactgcctggcccactggcttatgacaatgaacaagcagacctacaagtggtgacatcacggcttaaccaatccacccaataacatcaattttcccaccaaaattggagaaacttatccaaacgatttcaacttatccagagagtagctagacaaattatcctgcaatgcccagattgccagctcacaggcacatcccctccttctacaggtgttaaccctagaggactagaacctaatcagttatggcaaacagatgttagacacatccctgaatttggaaaactaagatatgtacatgtgtccattgataccaattctcatgtaattagtgctcatgcctttcctggagagtccacccgatatgtcattaaacatcttcttttaacttttgcatttatggggcggcccacaaagaataaaactgataacggtctggcttatgccagctcacagcttcaacaattttgtcacatgtggaacatccaacattccacaggcatcccgca

SEQ ID NO: 1886 - DNA, 2400 bp, artificial
  synthetic oligo
ccctttttatagtgaatacagtatctccagcacttaggtcagtgcctggagcatatgaggagctggataaatattgaatgaatgagcgaatgaaatcatgttatgttacctcttggagagtgtgtaatgattcctcaaataacttcacgcagcaaggaacggtgtgtacaaaggcagggatggcacctgtctactggcattggggagaaatcatgatggagcattctccagatgaatgcaaccttgcaaaccacgttggccacccttcctactttctccagggaagtagcatcaaagtcattggcgaacatgggacttctgtctagagcttgtccaggaatcaatgggaaagtgttacttgaactgaatgttacataaatccctttaaggcccagctgaaacccagagacatgtgagaccttgacattggctgcttgcagacccaaacgaccagagagaggagcagggaattgggacaagggccacagctgcctactggcaagagagagtgctcagatagccactgatgtttgtagccctgccttgctgacttccccaggatgccaggagcacagaccaggcgctggggcagcaggtctctggagtccctagagctcagttgcttacctgttccatgactcaacaataagagggtgctgggatgcatttaaactttgattgctgggtaattgggaggactgaaaatgccacgaggctccaatgcagaggctgcgaatactaggaccatggagctgtagttcttcatgcgtcccacagctgagtactgagcatgtactgtttgccaggcactgctctaagctctgaggatacagcattgaacaaattccctgcttctgtggagcttatgttctagcgggaggggaggggcaggcacacaatgaactgcggaacaaagttacaggtgaagtaggttttatggtgacaaacgctatggaaacaaattgaatcgagagagctaaataaggagtgctggaaactgggtggaaggagggattgcaatttttacaatggtattcatagaaggcctcacagaagagatatctcgagagagaaccgaggatgtctgggaaggaatgctaacagtattataagagcaatcgtctagaagagaacaaagacatgcagtcgctcggggccttggaacagagtgtagagggcagggtctagagacactggtctggtgagccaggtaaagggtattccctgatcctctgagccatggactgcctcagagccaggtcagctgcactgtaccatgaactggcttcttggatccaggtttctattccaggttactgacttgacctgaggactgggtacggaatacaggtctaggtgtccagaaacctttctctcgggataaaggggatggaaggcaccattggcattgaacaggcaaggctgttggcctgctgctgtggcactgctgcggcgggcaggacaatggtgcacgtgtaaagactgggtgcagaacaaagcagaaggctgtctggtgacacctagtgctcattccagagtagactctgtgtcttcaatgaggggccagatgtcttaatccaggactggatttcctatctttcaaagttcacctcaggtggaggccagaagcaggtttggctttttgttgggggggaaggtacacataggaggctctttgtgcttcctactgtactccagcaggaggcatacaacttctggctgttcaacccttgatcatattggctctgatcagtgggctcaggtggagaggtggagacagccttgttcctccattgcagagtgcgtcatcaacccttcaacaatgtttcatccattgattagcatggattgcatcagttgcattgctggatattgcaaatacttgttttccttttctctcatatgttgcattttcctcagctggaattctccagtaaggaagaaactttcctcatcaactgtagctattgtgtcatcctgaaatacagttagtacaggaaatgcaggataaatgttttattctctctcttgcagagccaattctcaatgtgaggggtggttattcttgttccttccaatggggtccaacaagtcattctttattaatgactttttattttagaaaatgtttaggcttacagaattattgcagagatagtacagagaattctcatataccccacacccagttttccctattaccatcctcttacattagcattacacatttgccacaattaataaaacggaagacaaaaacaaggacactagaggaatctgaagcctctggcatctataggtataagaaataaagcccaactcccagccaaattgacatacatcctcactgtagagatctaattgcctctgttcctatgacctcatacaacacgttcactc

SEQ ID NO: 1887 - DNA, 9200 bp, artificial
  synthetic oligo
ggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacacgtgcatgatgtgtatcttctttgctggatgggccaggaaactggagtggtcctctcagccagcctcagaggaaagaaatctctagctggcacaggcagccagtgagtgaggctggcggctgcaggggcacagcctttagaatgagtccttcagtgcacaggtcccagggtatacggggtagtgggaggaaggaggggacgcctcgcagatgccactgttggctgggctacaccttgccacacttgttactgcttaggaggctttctggagtgttccttgggtgctacgacaatctgcagcagacactgtcctttcaccgctcctggtcctcgtttgctccccagtgatgtcaacagctgaggactgctcacgctgcaacaaaaggctctgcagtcgctgtctagcttgccctagtcgtctctagagttctgcctgaactgaaactcaagtggggttcagctcatgacttgtggcaattgaccaggaaattcaccagttgctgtggctggaaggattttcagtcctgtgggttgtaaccagaggccacaggtggattctgccttaggctcatgagatttccgacttgctgttgaagaaaatgccttgtgaagtgacaacagtagctctgacccaactgccggtgcctcgctagttcctatacgtcccactggatcctcacagccccgggaagcaggtgctactactcttatccccgggaggagacagaggccgagagaggttaagtgacgtgcccaagtcacacagctcggcagcggccgggttgagcatcagcagtctgtttgcagacccctcactgtcaccccctgagccagtgcgccttgggccctgcggtcaggatgtctcaagcgtggaggcatcaccggttcgtggcagtctctggaaggtcactgagctctgtgcccagaatcgagtcgggggagtctgtgcagaggtggccctgtgtgtggggacagtgtgtgacacagacactgctttggatggacacctctcccgtgacctcctagcatccaatcccaaaggaacaactgttgcagagatggaccgctggacacaaacccacgtgcgtttctctggagacactggccaaggaaaacaaaacatgctcgaaggccaacagctgcatgccccaccgcgatgtgaccgcagacacccggggtgtagaagggtctctgcctggtggggggacacgtgcaggccgaggagaggcaggaaggaggctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggggttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtcttcatggtctccatcctttttctttctttgcagtccagtacccccctccgacatctttggcttgcatgatagagacttcagcctaacacgcctccctggaaaagtgcccaggagatactcgagcaggtgctgggttttaggaagcccctcagacatcccgcctctactcattaaaaattacctggagctggccgggcgcagtggctcatgcctgtaatcccagcactttgggaggccgaggcgggtggatcacgagctcgggagatcgagactgtcctgactaacacggtgaaaccccgtctgtactaaaaatacaaaaaattagccgggcgtggcggcgggcacctgtagtcccagctactcgggaggctgaggcaggagaatggcatgaacccgggaggcggagcgtgcagcaagccgagatcgcgccactgcactccagcctgggcgacagagcaggactccgtctaaaaaaaaaaaaaaaaaaaaattacctggagttgctcgctgagtgctaattgtgctgctagcattgccggcctagggttcacaatgactctgtgttactggccattccttgtcatggcggtgcctttatataacaggatcttcactttacatacagatgagatcacgtctggctttgtcattgggttaaaaagtgcccttgatagttgtggaggtgacacatactaccaaggagtcctacgggtttgcagtttagagggtgctcattagtgtctggtggacaggatttatgtttggcttttatgtctgtactggatctggtggggttttttacttccttccttgattcccccactatgcccccactttttctttcttgtttcccttccttcctactttcctttcctctccttttttctctctctctctctttgcttccttctttccttccttccttccatctctctctctctctgtgcttgcttgcttccttccttccttccttccttccttccttccttccttccttccttccttccttccgtgtctctctctctctctctttccctcccttccttccttctcctttcttttggagtcaaaaattaatttaaaagatgtcatgtcatgttttaacttaggaagcagccttttctgctcacttggggtgttcatcttagaacacatgctatcatcgacgaacttctttgactgatcagaggaaatagattcaagttcttaccgtagacacaactgggcacagacatcaaaagagctctgaaatcagggcgtgcagagagccccaacacccacacaccagaacccagaggtatccctgcctgtgatttttaatttgacagtaggtggcagagtcctgggagacgtgggaagaggccataagagaatgcagacatgggaatggattaatccagagtccagccatggtctgcaggtggatctccctgtctcggcctgctcacttacaaatgggtgctcatttacaaatcggtgtgaatcacatttcatcatttgtgagctccttagtttccaagaagtacagttttctcatgtgtttcttggactttatgcatatgcctccagagtttgaatcatgcaaagatgctgccacttaaaaacctctttcctacaaacttacacccctccgatcgtggttttcctgtgaatctcagctgggcacgatggctgacgcctgtcatcccagcactttgggagactgaggcaggtggatcacgaggtcaggagttcaagaccagcctggccaagatggtgaaatcctgtctctactaaaaatacaaaaaatagccgggcacgttggcaggcacctgtaatcccagctacttgggaggctgaggcaggagaatcgcttgaactcagggggcagaggttgcagtgagtcgagatcacgccactgcactccaggctgggagacagagtgagactccatctccaaaaaaaaaaaaaaaaaaaaaaaatactgttagaagaatggaaaaaactatatagatggagagaaaatattagtaatctgatatctgataaagaactcatatgctgaataaataccaaacatttaacattcaacctttgaaaacaaagaatccaactaaagatgtaaatgatttgaagacattcaccaatgaagacacgcagaaatacacatacattcaccaatgaagatacacacatgaaaagatgatcaccataattattcattaataatgcaaatgtcaacagcactaagattcctctacccacctattacaatggatagaattcaaatacctgagaatatcaaattctggagaggatgtgggattctcattcatagctggtagacaagaaaaatgtttcattcactctagaaggccttttggccctttcttatgtagtaaaacatagacttacctttagatccatcagtcgtactactaggttttacctaagtgaattggaaactggttctcacatggaaaatcgtgtacacgaatgtattagtagtttattcataatcaccaaccaagatgtccttgaagaggtgaatggataaaaccaatggtacttccacaaactgaaagtgtattcaaagttcaatctaccctcaaatattccaggacaggaaattttggaggccagttcagccaagtggcaagggaaaatgaatcaccatcttatctcaactcttccaatgcatccaaaatgggcaattgtttaactcattctcccaggctcgctctcctagattcataaacagatgaaggcacccgagcactcatgaaaagaatttgtgaggcaagtgttcacacacatcgcagcaaatgtcataaacagataatcacatatccaacacaacagtggattaaacgaacaagctgcctgtatgcatggaataaaaataggattaaatgttagaaaaaaattcaattctaactccctgcatacaagatagactagaaaaaaacattcagtcatgacaatgggtacaggaaaaggctctgaaatgaattctatgtaagtacaaattaacaatgtttagcaaactaacattaaaaggaacttccatttcctaaaattggcagcaagcatacataaatgtgaaatgtcagaagctctgccattcacggcagtgacaagtcgttgacatatgctgtcaccactaccacctacatctgcagtgaatatcaaaatgaaaaagagccagagctatggatgtcaagatgaaaatgagatatgaagactgcaaagaaatagagtatttgttaactatatgattatctacatagaaaattcaaaggaatagacacattgaatattcaaatgaataaaagacttcagaaaacatcatacagaaggtcattaaagcaaaatcaagagccttgccacacaaaagcaacttagtatataaaatagaaaatagaaaatgcaccattcacagcagcattaaaatccaaaatgtaaataagaagagcctgacaagacctttatggaagcaactgtgcaaagttgctgatagactcaggaaataatctcaagtaaatggatctgtataccatattccttgatggggaacagaatatggcaaagatgtaaatgctacttaaattaaatacagagtgagtgccttaactgtcattgc

SEQ ID NO: 1888 - DNA, 1350 bp, artificial
  synthetic oligo
gtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatcccccctcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgt

SEQ ID NO: 1889 - DNA, 3800 bp, artificial
  synthetic oligo
cgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgttt

SEQ ID NO: 1890 - DNA, 3150 bp, artificial
  synthetic oligo
tccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgcaggagtggatggtgcagagcgccaaggggaatcaaagacgtgacccttccatccaggtgagcaaaggatgagtactcagagggctggactgcaccctcccctccccatcctgtgcttctgactctcagatccacttctgactctcacttccagcttctgactctcagatccactcatggtcccatatcgtggatttatggaatcctttcccgagtctatttgtacttttagcctgttctgtcccttagggattgacaaatcccacgatctgggcctgccctgtaaaacaactatgtggggcctgacctggctgctttttagcttgaaggggatagcagagggtagaatgctggttacatttaaagcaccctgctcccagatccaaaagaaagtttctgctttttcctaaggagttgaaacagtctgggattttatctgattttgttattttgcctacaatgacaaacactgcttttgtttgttttatcatgttgtgttttttgctagatgagtgtttatcatgccggctgcacccatccaaagcagtaaggttgttgaaagccaaaagcagcagaaaggcccaaagagatcaccccacctcacccacaggctcacctctgcaggtgtcttcagacagctgactcttaactctcatctcagcaacagtttctaagatagagagtggaataaagagtcagcattcatccatttcttcgatgttttctcctttaccccatgtgaaccaagtttcttggtaacgtgcagctaggactcacacagacgaaaagcacagagccacaggccttggctgggttattggagctaggtgcacaggaaaaataaaagtgggtgctccaggacattatatatatagtcctgggctaaaggtggccttcagggcctgaaagatggatagctgtacctcactaggaattatcccacctcttgctttgcttgtgggagctttcagtttgcagctaaaggctcaggttccggccagctttttcccctgtagcatgctaccaaatccggccatcttccagttttgagcagaggaggtgagcgtagctgtggagacacatattcttctgcaggcccatgtcggggtggcccatgaagagaatttgccaaagccagctggctcagcagaccaacagatgaaggtggactactcatttgcaattgtgattaatgatcatttatttccatgtgacaaagctttgaacgatgtgggaggccctcacccatcc

SEQ ID NO: 1891 - DNA, 1800 bp, artificial
  synthetic oligo
aagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggatggtggtgatagttgcacaacactgtgagtgcacttaatgccactgaattgcacacttaaaaattgttaaaatggtacattttatacatatttttaccacaatgaaaaagtaaaggctgcaattttaaaacacttgctagtcctctcctaatcaaaagcagtcttttcttttgcaataatattagtgtacaatctaaaagaagcagcaagctgaactgctcattttccatccctggtaagagcagtatttactgcacatccactcatcatgttgtatgggccatctgggttttttgtatgtcttactgaggtgcatgtttgttaaatgcacaggcataaccagaaataactttcctggaaaattgagcataatggctgtccctctcttgacattttggagaaatgataatacgtaggtgggggaaacaaagaagtgactgtaaacaagaacggacattatctctgcttctgaatgagatgagaaacccacttgcttcattagctctctggtatatctgcaagtctggaaacaccgggatgactcacagtttgctgagtaatacaggagccgacagaatgctgctagtgactcgccatctctgactggctttctgtgcaaactgtcactctagagcaagtgctaggccttggaatagagttctgaaaaaggttacggttctcaactacagggagaaccagctcctaaggccttgacactggtacacaaagtaggacacctctgaccaatgccaaaatgacttttagaaagttcacacctggtcattgtgtccctgctcatgctccagctcacaagatctctggtttctgcctttcagggtgtggtgatgtccacttcttcatcagagttctttgtgacttgtctgcttctccacttggtagtaaactcctcaggcataggaagacgtcttcgctagctctgtaatgtaagctgaatgatccttggaatgaatgagtagaatatagaggggaatgaaccaatgaatgagctgtatctgctagccattgcggaatgctaagttttggaaactgttttgagcattttagaggaagtattgatagacactctcagtcttcaaggcttggaggccgatgaacccatattcttgcactgggcagaaaggagaactttgcatctgcatgtagggcccatttacccactgaccatgatgcatttctctggtccagttaagctccttatccttctatagcacttgtgcaatgtctgaaaacatgtgatttcttcaacttccaacaagtacacaattttataccgccagtggtaatttgtcctggtggttctgttgtttctgctgttgttgttgttgtcgtcatttaatgcaatttacaaggacaaaacaaaacttctggctgccatttcacataccacagtgacagcttcacatggtaagaaaagccaaaaacagctagtttcgaaattcaggccactcattttattacttttccctgattaagattcattcataccactttggggtggtgctgatattcctaacataagccaatcgattttggtcagttctgagagcagtgagtggtcttcacttacacacagtgtgt

SEQ ID NO: 1892 - DNA, 3300 bp, artificial
  synthetic oligo
gcaaggaaagacccctaacatagaaaatggtgtggcagtttccagttccccattggggtcccatgacttgaccttaggtttctgccagcacctgcccaccctccatcccttcaccctactgggtggtcattagaacattatctgctttgattgatttacttgtgtccataagagtagagacacacggtgttatccccatgcccggaacagagcctggcccatagtagacccatgaccatgtttgttaactgagtgacagagggactgactggactgtcatgtaagcaataccttcccgtcagggtcttgggaaggtaggttcaggggccccagagttactgtggcccgtatccctctggctgcattctgggcaacgcaaaagggcaggtgttcagtgggttccaccccagatctcggcgttaacagtccactgggagaagtggcccaattcgtgctcattactcccagtggtcctgcctccctgcaggcattctggagaagctgagtcacaggctctgagagttagggggaacttaggaaacaatcaaaacttgcctgccattcattttaggaagccgttgtagtttctgagggacgactaaagggaattttttcctaaaagcatccatccgtcctccaactaggcttcagatagcagtgtgtatgttgtcactatctatgggccatggccagtcagagcccacgggtctcagggggctccacccatgtgggggtgggggtccccacaactcagatcttgaatgtgtggtggtcccatgcagtatactatcttcctgtcattgcaaagggaaagtcagaagggtgaacgagttgtttctaattctggcttccaaacagtacaaaagaaggtttttttccttgtggaatacactagtgctcaacctttgggacagatagctgagcaccttctgctgtgtggcaggctggctctctgtgggggcactcatggagcagtgtctgctggaaaaggagacaggagttccctagcatggaggggtagataatctccccgctccctcccctcttctgtcctcccttccccttctccctcctcctctaccctcccctttttcctctcccctccccttcctcctcctcctcttccttctcttcctcttctttattctctctccctctcagtctccccttccctcccttccttcctcccttcctccacattctttataaaacaaggctttggatccattcactgccatcccccagaagtcttgtcatttgaattcttgtctgagtcaggatgctctcctccaagggctcatagggcaaggaacttcagcccgaatccggctaaaatccaggaacattttgtgggcatctgtctcagtccccgaatcgtttgtcctctgcctttcccccgttggagtccttttgcctgcttaagtggttgaattggtaatgagatcattcttcccatgcagtggtgagaaagcagcactcaggtgattgcacctgggtaaacaggagacattagcatgtggtagctggtgagtgaagctggtgcagtgcctggcgtgggctcagttgtgccagcaggcagtggtggagtttgggctctttcccctctctcctgcccagcacacaacccccagggacaggtgggggctttacagctccctggcgtcagcctaaagcttctagaaaggcatccccaggacttccaaggttgccatcttggctgagactgtctgtgaatgtggtcccttgtctgacagtgggggctgggaggggtgtgacagaggaagagctgggccttagttctctgggggtcaccatgagagaagcacacctgggcttgcatagaactcagtgctgcttgtcagtgtcacctggcacaacaggacgtagtgccacagttgcagccctagaaaatttgacgaccccttcatagctttgtttataaaaggccacacggcctaggctgtccttcataagagagcagaaagcgagtgtcccagtcactaagcagcaactttcaggcacggtttcctcctggtcactgaaaccatttgccatttcctgttttctccattttccaacgattctaattgtcagtgtcaaaaggcaacaactgttttcttggggcttatctttggagcacattgattcagaacaaaggatgggagcctccatctgcaaaacaaaggaagcagcctcctcgggaggcctggagagaatgctctggctcctttggccagggacagcaggaccagcataggagcagaggactggcggtgcctctggacactgccgtaaggtgaagagcccatggaggaccgtcgcttgctggtggcaccccagacttgaagatcctgcagagctggccaccggcacccaggctgggtgtcagcagcgctgtgtggccttggcagtttccatagtgataggctggccagcttttccattagactccggggtcctctggaatgtgtgcttcccgggatgaagacgccccagcacccgctgaagcctgccctgccccggcgtggcctttccttttgtctggcacgcccctgggcttggctttctctttccgtccctcccttcggactttaccgcacttcccctgctgtttccttagtcacactctccagcctccatctgcccctgcccctgaacccctacctctgtacaactgtgttatttgatgaaactaatgcagcaaccggtggggatggagttaaggaccgtttagacctagccagccacgcaggaatctgtccccagaagcagcagaagcacctggtctgcagttaggagatactgtacttcttagccgtgtcaccttgggcaagtcatttaacctctctgagcctctgctgtcacatcagtaagctggggactgtagatcttctgccctgatgtcctgagactggtacaagaagagccaaagcgaaaggactgccttcagaaatggctgccaaccctgaccatctcaggcagatccggatggtgtggccttgggcagtggtcatgtgacccccatgctcctcagtgtccacatggggtgttgctagatgacataaaataatgggtgagacgtgctcagtataatgagagcttgagaaggcagatcccaccccccatccccacccccaccccttgccgccttgccaatgctttggcagggagagggcagctccatagggcagctgagaaacagcccctcactgcccacacggcagctccagtggagggggaggcagggaccaggacaggaagcaggctaagggcgggatagaaaagcaaaccccagtctgg

SEQ ID NO: 1893 - DNA, 2700 bp, artificial
  synthetic oligo
caggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcctctatgtttttatttttcaagggagtattcagtacctacaaacccaagtcaggaagcctgctagtggctttggttctttcagaggctgctcgatgccttgtgtgtcagaaagaaagattcagcagttttgcatcatggcaaagaagcctgttattttggggctcagcccctcattttatagaggatgaaacagagggggatgggaggtcacaaagacaactgccccgggagcaggtgtgggggagacttgccctgagggtctagacgctctgcaccaccgtcctgtctcccttgctgaagaccacacatgcccttctttgaccagaccctgccacctgataggccaggacctggtaggcgggtacccaggtttcatggatggaaccacatctccccaaaagtggggaggtagctactgggatgcacgcctcccgccatgtgctataggagagcagctgaagcaacagttgggatcagatgtagtcacaattgaatgcatcatcacatttatccctctaagtggctgggagagttgatatcctcatccctaaggtacaaaatgttccaatttgatcagtggctttcaggagctgagaaaggcatgtgctctgaggcagagctgttatgtcccgcagagcctaaaaatgctcta

SEQ ID NO: 1894 - DNA, 1400 bp, artificial
  synthetic oligo
ttagtagagacggggttttgccatgttggccaggctggtttcaaacccctgacctcatgtgatctgcctgcctcggcctcccaaagtgctgggattataggcatgagccaccacgcctggcccagtgccacacactttcaaacaaccagatatcatgagaactcactatctcgagaacagcaagggagaaatctgcgtccatattccaatcacttcccaccaggtccctcctacaatatcaggaattacaattcaacatgacatttgggtggggacacaaagccaaaccatatcaaccttcctgttcacatctaaaggtccaaaaggagtctcaggctgtgactggatctccactgattcaccacggaagcttaacccaatcttggctcctgaatattcccagttaccctcaaaagaaaactctcaggaaaacaccacacctcctcattcatcctcctcagaaatgctgagagagggcctcagtaacttgaccctccaacagaaagtctgtccccagagcaggacagtgaagataaaatccaacaaaagaggccattagatgaaacattgttactttgaatccttactcagcatttatattatcagaatcaattgatatttaattttgaatatcatcattttatgaattgttctttgaaccttagagtgaggaaaccaccctctcatccttcctcctcaggaatgccagttaagggcttcagtaacttgaccatcagccctactactaactaactacagtttccctgtactagaagagctatttcaacagcaggacttagaaaagatccaacgaaaaaggcagcagaaatgggacttgctgtttctccccaaaagagaactctgagggggcctgagatttggagttaaagatttgtcttgctcataagatggagatcagactgtatacaggtatgggtgtccatatcccattgcaaaaataacttcccaggtactgaaaatgatgaagaatccgcaaggagcaacaagatgcagaattatgccaaggaatcttactggcagcaggtttgagtcaacatcagtgccagtaccaaaactttccactagcaatcttaggatcactatggggaaagctgctaggtttctgaaattgaagctttttctctcctcagatgtctttctcccttccatgttatctacaatttaaagttatctacagagctcggatgcctcttggattgtaatgtgcttttttccatttcatggattgaccatcctttggcacatcacatgtgtatattcagatcgtaaactcaataatgagatgaaaccgagcattatgagtatgaagcagaagattgttggggcaaagggatgtggaaatcgatgttagtgattttacactgtatcgttaggtgaca

SEQ ID NO: 1895 - DNA, 1050 bp, artificial
  synthetic oligo
gtttgggaagccaggtgctgtggttcacacccataatcccagaactttgggaggttgaggtgggaggatcgcttgagcctaggagttggagaccagcctggacaacaaagtgagaccccatctctccaaaacaaaacaaaaatagaggcttgggtaaaacaagatccgtcagcagggcctgagaagtctgtccccaccctcgccatttggagggaggggcagagtggtatattccaaaggccagttcatacactcagatcaaccggaatggcaccaactctatggagtggctttgctggggtaggggacaggtgagatggtgggagatcacttacacttctctcaggcttaagtgaactatctcgccatctacatccactttctttatttcctttcctagagaatgatgtgcctccttttcccctgatgctgtataaacatagctcacaaccaacacagctcacaactaacacaccagcatgcttgccaatcaaacgctgtgttgctgtgctggctcatttcaatctaaggcaggcattggcatccaggagtttggagtttgctccaaagttttctagttttcattttggtgaaagaggcgggcagtgtggtgcagtggacagagccctgggccatgaggcaggagccccgggttctaggcccagctctgccactaacattcatgtgaccttgagccagctcctggccctccctgggactcagttccccatctagaaaaggaaaagtttacattagatgctaatggtccttccacttggaaagttgtatgattcatagagtctcaacactctggcaagttaagagctgatttgaaaaccaaccataaatatttaaattaagtagcaacatatgctgagcttatcacataatcaggtgtcacattagtggagcaagatctaaaggagagagggcaatgcctgatttggtactcacttccctccagatcccccaatcaagtgttccagaagccggatttctgtcgaatccttagcttatcatcatcattagcatcacccagttccttttttt

SEQ ID NO: 1896 - DNA, 3000 bp, artificial
  synthetic oligo
acaagcgccggccaccacacctggctaatttttgtatttttagtagagacagggtttcaccatgttggccaggctggtctcgaactcctgacctcaggtgatccacccgcctcagcctcccaaagtgctgggattacaggcgtgagtcactgtgccgggccagaattttaaacaagacagaaaaatgtgtatttataaaaattcagccaggtgtgaaggctcatctctgtaatctcagcgctttgggaggccaaggtgggtggattgcttgaagccaggcgatttgaggccaaactgagcagcaaagggataccctgttactacaaaaaaattaaaaataataaaaatgtttaaaaagtaaaaagttccctccagatgataggagacggctgagcagggagacgagttaagggagagacagatagacgatctctgcttggtagtgagaggtggggaggagcagctggattcggacatgtttaggatttgctggtagcctggatacgggaagtgagggcgagggaagagccaggcgggacgctggggggatggtggtgccattctctaagcacggatatgggggccggggccgaggttggggaatttagtttgggacacactgaggtgaggtagtggcaggtcacgtaattgatgacttcagcaattgccctcaggccctttcacctttgctgcccttttctctggctgtctgcaggcagaagagtcctgaatggtcactgacaccggactgtacagaacgggaaacagatgccctctgtgcatctaaccctctccttgtttgtttgctcactgaaaacaaccaggcagtaaagcctgttacaaagactgagaggggaggatcactggaactcaggagctcgaggctgctgtgagctatgattgcaccactgcactcctgcctgagcaaaagagtgagatcctgtctcaaaagaataaaaataaaaagacagagaggcagagttccagttttctcacagatggcctggtatacttggacaaaacagttgcctcctctgggttgcagtttttccaaaatatgccaaaacatcccacgtgatcattagggggtgcaagtcagacagcagatacgcaagcaccaggcaaactgttaaggaacaaaatgcaaggtggcatcattaccattcacatcatgttctccgctttgaattgggccatttgctgtttctgtttacagttccttactcttatcattttatctgattgtacttttctctgataaccagtgaatcatgcagaccaggtaaaaacataaccaaaagtaaatggaaagttgagatgatagtctagacaaatcatgtttaaaagaaaggtttttacttgaaacatcttgaggcaggctgatctgagaggcacagtgaatctgacaccaagctgtccagaatcactagaaaagatgattaccaaacaaaggggatctgtttatgaatacaaacataccttttcaaattagctaggtgtggtggcacgcccctgtagtcccagatactgaggtaggaagatcacttgggcccaggagtttgagattgcggtgagctgcgatcacgctactacactttcagcctgggtgagagagtgagacctcatctcaaaaaatccaaaaaccccgaaacaaaaacaaaccataccttttccagttcactacaagaccttagaatcgcagcgtcttcatccattcattcagcaactattcactgggcatatacaatggactttcttcaaggcatctgggaaacattaggaggaaaaccaaaccaaaacaaaacaaaatttctgccctcttttaaggagcttatgctccagtggctattagtacaagaaagagccctggagatgatccagtatctagtaagactcgctgactgtacagaacgggaaactgaggaccagtgaagctcaggaatttgccaaagcctcttgaagctgtagaagagcagagagcagagccacatcctatagctcctgggttactagtccctctactgtacctttcttggtttggttttggcaacacagctgtttgcccgatacttcatggagcaatatcacctgtccagccagaaggcaaggatgcgggtgacactcacctgtccacttcccaaatgcaggtccgttctgctggagacaaaactctcccacacagcaaacactcactcagcttgtactttgtgccaggccttgggcggggcactgtggaggtggagccattgagaggtgaacggaactcagtccttgctctggaggagctgctgccggaccctggcagcgcgatggcccaagtgcccctcaccgcttctggcacagaccaagatacacaggaccggcaccccaccaggtgttgcagcataaatatttgttgaagtagggctagcgtgggtgtgggtgtgtgtgttcagatgcacccagccatgatgccttgattctacagctcaggtcacagacagatgcaattcccagcaaaggcaactctcttggttgtagaaaaacacagttcaaagcctgtgctaccgaggtttggattttccttcagtgactgctcttctgcactgtctgaagaattaagagtgaaatcaaaggtgactctgttagaacagtgaacccttcttgggcacttatttttgtgccaagcattgctctaaatacttcatgtgtattaatttgtttaatccccagcatttataaggtaggtactattacaaggctcattgtgaaaatggagaaactagccaggcgcggtggctcatgcctgtaatcccagcactttgggaggctgagatgggtggatcacttgaggtcaggagttcgagaccagcctggccaacatggtgaaaccctgtctctactaaaaatacaaaaattagccgggcgtggtggcacacacctgtagtaccagctactcgggaggctgaggcaggagaatagctggaacccgggaggtggaggttgcagtgagccaagatc

SEQ ID NO: 1897 - DNA, 1050 bp, artificial
  synthetic oligo
agtgggctgtctgcgatctgtctgagatactgaacctctgtacttttggttgattatcatcaaggttttagaagtgcaaactttgtggtaaccatagatctgaactactaacatttagtggaatgataccatcaaaatgacttaagtgttaaggactccaaagccccaagatcaacctcctggcccgaggcataagggggagttggctctgaagccctggaccaggataaataggcaatttgcaggatgctaacgagctactatttgataaagtggttgggtacttgtaatcagccagccctgcccacagggctcctcgaggccaagggtctgggcttagttggctgactcagccatgcccaacaaggagttctggaggagagccacagggaccgcttgctgttcttggctcccagctcagttttctgtggagcccaaggctacctggtaaggaaaggccattgagccagcttggcggccccaagcttcccttactgcttcaaccagagcagcctcccaccctgttttatatgttgggcatcctacgatttcagctttcaaaagaagctgggataccatatcaataaaaggaaaaagacacacatgatcatctcaatagacacaaaaaccttgacaaacactttcatgataaaaacaagggtagaagggaacttcctcaacctgatataggacgtttaggaaaacccatgggtttattcatgattgtactagaagttctagccagggcaattaggcaaaagaaaaagaaaacatccagactgaaattgagaagacaaagctatgtctatttgtagatgatatgaccttgtatacagataaccgtaaggaatctccaaataaaactgctagaaaaatgaattgatcatctgcagtatacaagattaacatacaaaaactagtatttctatataccagccatgaacaatctgaaactaagaaaacattctcttaaatatctacaataacatcaaaaagaataaaatatttaggaatgaacaatataagtgcaaaacttacatggggaaaagt

SEQ ID NO: 1898 - DNA, 1000 bp, artificial
  synthetic oligo
atatggctcactgtctcctttgtgacagatctctcttcacttccctcttattcaccacactctagccataccagcttccttggtttccttctaacacgctggacacactgttgcctcatgtgatctcatttgctgatcgctctggctcgaacactctttgtctaatcatatgccagtctttgctcaaatgtcaccttcttagaaagtccttctttgacccactcgatttaaaactgtgctcctgctccctttccagtttctccgtagcacttatcatctggcatactctatcttttacttacttaccgtttgtcttctccaaccagagcaccagctctgtaagaagagaggcttttgcttgttctgttctgtgatgtatccttagttctagaatagcttggcacagagtaggcactcaataaatatttgttggataaacacatgaataaaaaaaaaagtgtcatttcaaacacaatcaactgggtaccacatcctgtctcaaaccaaaactcttttttcatagtgcacttctatgccgacttttttgaaatctgatgcctcactccacactccctcatcccagcatggttaaggtctccatgtccaagcccatatcttccctgtgcttttctctgtataagcttcatcaatatgtatgtatatgagtcattttttcccaatcaaaactgccaacaatcttgtctgcacttgctgtctcctttttcttacttcccacacattcctcacctcactctgatctgacttccttttctatcatgtcactaaaacagtttctgttaaggttccaaggctctctgtgtcaccaaatcccttggtcacttttgatccttatctttcttcgctcacatgccttctttttgaaacccgctctgtccttgacttccagtccccagcactcttctggtttgtcttctattgctccaactgctcctttgcagggtcttcttttagtcaacctctaaacaaagagtttcttaag

SEQ ID NO: 1899 - DNA, 6400 bp, artificial
  synthetic oligo
cccagcactttgaggggcggagacgggcggatcacaagatcaggagatcgagaccatcctggctaacattgtgaaaccccgcctctactaaaaatacaaaaaattagctgggcgtgttggcaggtgcctgtagtcccagagctactcgggaggctgaggcaggagaatggcgtgaacccaggaggcagagcttgcagtgagccgagatcgcgccactgcactccagcctgggcgacagagcaagactccatctcaaaaaaacaaaaacaaaaacaacaacaaaaaaacaaaaacaagcgaacaaacaaaacaaacaaacaaacaaaaaccactgtctgatgaagctgggttgtgggagaaagaccttgagctgagagggaatccagcctggatttaagccttggcatgaccttggacaagttctttcacctctctggggcctcagttttcttatctatttaatgacattgtgagaaaacattttcccaatgaacttttgaaaactataatatgcttatttaaaactgtactcactagttacaagcaaggcattattatagtgctggagggttaaacagagagcttagaacgtttgataaaaggtaaccttccatcattgccgatgtaaatcagggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggc

SEQ ID NO: 1900 - DNA, 3800 bp, artificial
  synthetic oligo
tctgaacatctagattttacttctataaattacacaaatgcattgtacattcttaaataatgaatgcttacaatattgatttgtaagcctttccatatagaatgactcaacacaggaatgtgaatgaatcaatgttactgttatagattgcaacactcttttgattttctcttttgtggctgttgttttatcttcctggtttctgcaggctactgtaacagtccttttgctttggctatgaaatctgtttgagctgaatgaggcaacactggttattaaggcttatttatatgatggagtattatccttaaatctgatgccatttccagagaacggtgagagaatcacagctatcttgaatcttcagggtctgttttgatgactttcttttctaaggtaaaagctgagtgaggctggtcttttaaaatcccaaggctctctgatgagtgggactttgcctcactgggataaagtctgctcagctccccatccaccacaatatgatggggttgtctgttctgtaaattaggcattcggagattcaaaggtgtttctccttgtccatctgagttatcggaagtcaagcctttaggactgtgctcttctgagctctccctgtaaagccctgcagacagcctcctctcggcatgctgcagtctctcacagccagcttggttgcagaggaactccatctgctttgccatcaccttttcgggctgctgtgaactaagggctgcgagttcttcactcttagctctagccagctggaagagcgtttgcacagaatcctggaaatctggaaacccatcctccactttaatcctctacaaggataattcatctctttcttcacattttgacttggtggttctgtaagtatatttataggtgacttctcgagaaacctgcctagccaaggcaaagagcattatccttcacacagagttgagcagccgcttcattaacagtgagctcatgaagcatgagatgttttccatccttcctctttgagtcaaatctgccatatattcactgtatttccaaatttcctcctctttgcgtggatcattatcgttcatctcaaagatgtgaccaagcattttggccaacgtcttgttggtttttagcagctttttcacttcgttcaagtcacttttcggcagtgtgggggccatccgctccacacactctgccacagagagcacagcagcagcatccagtgcctcgctgctctcctttggggacgtgtgggagcccaggtctgctggggagaggctgtgctcgctcttggtggcatggtggccttgccagagtctggactcaccagcactctgcagtgctaggctcccgaccacatctgacttcccctgtcccaagctctgcacacaggtggtggcaaaattggggaaattgggtggtaaattgggtggtaaaaaagttgggtggtaaaattggggattttaaaatgaggttcccaggcattgctactcctttcataactactgcaggatatttccagctatgtcagtgatccctctggtaatttatagatcggtatgttactgacaggaagggaagtcagcggccgattgaaaagcccagggtttgtgacccagtctcttaaagccttctgtagccttctaacatgaagcggcttgctagccatgcccacgagtgccatgatttccaaaaactcctcttttcctgcttcacagagttgctggacatcatcaccaccttgttggataaaggcatcaaaataagaaagcagattggctttttgtaatattgtatacagctgcaactcccccagggtcctgggtaaggcctcggccatgactgtgggtgggtttaactcagctagcagctgcggcggtcttggcgcgctctcgccgagggctgctcagccccaactcggaagcgacggccccggctctccctcctctggcagctgcggagtccgggacgcccccgctcacatcgaggagggaagggaaggtggtgggtgggctctccctgctgcctcccagctcgggcccgccgcttcttcccgccgcccgccccgactgcgctcgcttggccgccgtggcggcagcgcctctccccactcctatgtttttaattgagagccccgtaggtctctgtttcgtcggccctaaatgacctagggatggtaatgtcaaacaagtgaagtagtcatgtaaaccctcccacagatagcaataatagaacctggatgatacacccaaagacaattacttaaagacactgaaatgtctctaagagcagccagaatacagatgataatttactctaaaacttccagccgtaagactgtgattttgttgctttatagtaagaggatgacctgcaaaccccacagctatgactactgaaaataatgttagaaaatgatagccttaccagctcaaggtgccagagttcagaattcagggatgtaaaatcaacttgtaattttaattctagaaatatgattaaaaattttaaagggcaattccactgtgaaggtaactgcagcatgaatatgacccaaattctgaatataaattctatccaaatctctgaataacatcagaaaagcagtctgacaccaaagataaatctattcttgaaagatacgagataaaaacttaagctacagcagttttccagagatgggcaccaaagctctagagggcacttgtaattctttcatagattacagattttttaatccatgaaagattttgtgtggtggtggaggtgatgagaaagacctgagtgtcggaaagacttgagaatgaggttacaggttaaagagtggaggattctctccgtttctgccctcttacccttcaggtaggcccagattcgagtagtgatatctcaacatcaaagacaaataagtccttggttagaaaaatgaatagcagccattgtcctattactgggtgatcttttatggccatagtgttattcaaacaaatttaaatggggtaacttactttttaaaaatttttcccccacttttaattctgatagcatttctttcaccagacctcttacttggcactcagcgtatgtagacttatacaatttaagggttggaaagaactttaaagttcatttaattgaagttaacacctggtgtaggaatttcttctatgatgtctctgtatagatacttatgtagcctctgactcaactctcctagtgacggggaactctaccgctcaaggctgcttcacagctggatagctacatattttgttggagtagacagaggacaagtctgagcaagagactaaaaagaaaccacaagagaagaagatggaaaatgaggcaagagttgagttcaggaagcaaaggccaaagagagactttcaagattgaaggttaacctgactaaacatttctgtcagggccgataagatgataattgacatgtgctcattgaatttggccttaagaacagtttcagagataagtgtggaggttgtacccaaaattgcaatggactaaaccatgaacggaaagtgagggaaaggaggcaatgaccagtaatgatttttctcaataaactttgttgagaaaagaaagagatatgacagtacctagagtgagatacaggattcagaaaagggttttttttgtgtgtttttttttgtggaacatgtgggctggttagcaggttttgttgctaaggagacaaagccagacaagagaatgagaccataattgatagatgggggtcttgagaaggtgcctgggagcaaatgggtcaaatctttagtgggagg

SEQ ID NO: 1901 - DNA, 1000 bp, artificial
  synthetic oligo
aaggaaggaggtgattcattccacccagagcagtgggggttggagatagatatctgtgtatgggtttgtgttgtctccccaactgggctgtgagctcttttcaggaggactgtgtccctcttgtctcactattccctgagcacccacccatcccagtgtctgcccagggacagggaactcactggcagggagttccaaggtgatgggatcccttctcttccgacaaattcatagaaacatggataaaacacaattccaaattccttttaatacttggtgcacacctcagaaattacttgcttgttagttacaaggtgtgtgtgtgggggaaatgtaactttacagtagagagattaggctgtcatcaccttaacccaggcagcaatcttggcacccttaataatgggacaaccagatctcctaatgtgatgcaacaggagacacacagcatcccctatgaaatattcttgcaagaagtcaagccattaaacctgattttcaatttacagaaaatatagagacagaggatcaagttaaacaatcacaaagaaataatcagtcaaagctagaacactggagaacgttcaacacggctggtctggtttctacaaaaagtcagtgtcatagggatggttctagattaaaatggaataagaagacataacaaaaagtgtctttcttcattggtgtgtaattctttggatcctgattttttcaaaagcagctatacaatgtagtttggaaacaatttatgaaatttgaatactacttgataataggttgattttcttaagtataatattggtattatggttatataggagaatgtccttatttttaggaaatacaaattaaactaattggaggccacatgccatggtggctacaacttattttgaaatgtttcagaaaactaatagataaagtaaatgtggcaagaaaaaaatacttttaaatatcgaatatgagtgtttgggtatttattacactattctttctg

SEQ ID NO: 1902 - DNA, 1300 bp, artificial
  synthetic oligo
agatgttatcaggagaaaagcatgtaaaaatcctttttgaacgttgtttctgacaactcactactaaatttacaattaaaattaatttatgcagacaatatactctacaaatgacaagtattacatacatacatgttgttatcacccctttgcatgtaatacggcacttaaagaagggaagtgatttgcttaaggacaagaattgcatgtgtgttggggaagaagagacctgatttctctgcccctagcagagcattgtgatttaggttactagaagtattacataaatggctgcctcgctaaacaactttttgctctatcatttcctggttatttcagatgtcatgtcatgctgaagcttttaaacttaataattagagtttgtttgtagtgcccgaaggttgcagacacagctgcgagtcagaatgttttatttaaaatgccgtcaggaagacccatgctgtttttaaatgagtcccttctgaaactgggtttaggagcttgtttctgaagttcattgatcttcaattttgatatggagaaaataatacatccaaagaccacctttcagagtggtcaacttttgacgttacaaggattgagtaggaggttgaatgctctagggccctttctgtgacatatcctccttgtcagaggggcaggggttatcactattatgaatacagtttaatattaatgatgttaaattaatatttgctttgtttttcctgtgcttagtgatagagcagaattaaagttggtttttgatcttttaatatctgaatgtctttttaacttgtctcaaaattggtcagtttaagaaaataacatgtagtgttaaatctattcctcattgaggatttattccactctggaatgagtggtgagggaggttgtgagatcatcttccccgtgagtgtttagaaacagactggagaaatcaaatggtgtaatatagggcaaccctgcaaagctcagtgggtatgtctcctggaaaaggccagagaggaaggcagattgggaggtgtgaaaaaaaggctggccttgtgattgagaccaccatactaaatgaggcagcaggtcaaggggaacactgtgcagttgttgccctccctctgacctctggggttccagacacccactgatgccctgctaagctggacttgatactcaacaagggtcgcattttgctctgtcaggctgcaaaggccctttagatcaggatgtggtcctaccttctttagttctgtgtccggaattggtgggttcttggtcccactgacttcaagaatgaagctgc

SEQ ID NO: 1903 - DNA, 1050 bp, artificial
  synthetic oligo
ttgtatccttaaataggtttgggtaaaattcattttccaaggcagtatcccattttatctgtttctctgttttcaaatttatgggtataacgttgatcatactgctttttactatgttgtatttataatatgccctttcattccaaaatgtgtcctctcccatgtttcttgattaatcttgtataacaatgctttatttatttcactactttttattttaagaaagcattttaagatttctgttttatctttatttttattgcattattttctggtcctatctattattttcttctcctttctttagctttacttttatttttaaattattttgtttactaatttattaattttgtttgtttgtttgtatgaaatggagtctcactcagtcgcctaggctggagtgcagtggtgcgatctcagctcactgcaatctctgcctcccaggttcaagcaattctcctgcctcagcctccagagtagctgggattataggtgcctgccaccacgcccagctatgttttgtattttagtagagagagggttttaccatgttgccgaggctagtctcaaactcctgacttcaggtaatctgcccgcctcggcctcccaaagtgctgagattacaggcgtgagccactgcgcccggccaacttactaattttgtttactaacttgtttactagtttttgtttgctttttttcctaataggcatttaagactaaaagctttggtactactttagctgcattttactttaatatatttgtaatatgtggtatacttgtaatactttagttctgagtattttctgcttttcagagctatttaggaagttttgttattttgaatgttcaaatcgatcaggttttgtattgtctttttattattgatttctaatttaattgtatttgggccagaaaatatggtctatatgataatattctttggtatgtattgatcttttttatggcttagaatggcttagctgttttttgtgctctgagatttcactgtgatatttctaggtgtggttttattttgattta

SEQ ID NO: 1904 - DNA, 1450 bp, artificial
  synthetic oligo
actgctaaaccaggtacttaaatttcaatggacagtgatccacagactattcaaaaaggattcagttgttcaggaaataggacaggatcactcaatagaaatattatgtatgtagtttaaggcaacaaatggcttaaaggtagccaggcttaggaaaaagagcattgggtttggagtcaatggattctatctctcactctgctcctgtctgtctgtatggccttgccctctttgacactatccagtgagaacattggactagaagctcttagaggccttttcacctctctgcttaaaatagttttgctaataatactttcaactttaatctgcctaaagacatgcaatagttgttaaacagcccctggttggccttttcttgctctaagcctaggatgcaagtgcaggaactctgggaaaatggccttatcagtggtggtgcaggtctcccactgctgtcccatttctctgtgaaccagtttgtttgggtctaataatgaggaatgggagatgaggtgactaccatccttggcaactatcatgacagcatcctactgacaccactgaaaggcagaattgtttttgccatgccttttgatctataaacattttttgatgcctttatttttagtgttatgtatactgtgtttctcttcttcagtttgtcagtgtataccttgtggcatctataatctccgcttgttatcttccagcaatatttttaaggaggtatttgatgatgatttttgttaggttttcagttgattgcagcagtgttagaaattgtgatgtgaaatgcatcaaagtttgtattctgcctgtgtttcctattctttctaactccaaaatgcaatgtcctatctttctcttttggaaatgtacaggaccaaattgatattgcagaggttgagcagtatggaccacaagaaaacgttcacatgtttgtagattctgattcaacttattgctccagtacagttttcctggatactatgcctgaatctccaggtaggtacatttatgcatttggatagggactattagaagaaaaacagtgacccccagggtagttacagtttttcaaatgaatataatgctctataatactgtgaaatcccagagtgaattccaactttcttcatcttctgtaaatatttgagatgatgatttgagaataataaaaatgagtatttcatcacagattcaagtcttttctcctatttaattttaatcttctaaaaattggcgctggatctcaatccttgaaggaatagcgttttatctttttatactcgtgtagtctattctgctatcacacagtatttggattccaaagaaacctcttgttattgagttttcatgccaataaagggggaaagtgagagtctctcaaaaacagtgatatttctttaatgagtttcaatattaaagatatttcgtaaccgtaatt

SEQ ID NO: 1905 - DNA, 1100 bp, artificial
  synthetic oligo
tccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcag

SEQ ID NO: 1906 - DNA, 1250 bp, artificial
  synthetic oligo
cacatatatatgtatatatataccctgagggcagagatgacatgctggctttcatctctactaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccag

SEQ ID NO: 1907 - DNA, 1300 bp, artificial
  synthetic oligo
ttcagtgttctccctggagcctggttcaccatcagcccagccccaacaggtgcctgatttccagcccacatcatgggatggacattgtgtcttggatttggttttccccagggcaaggcaggcaccttctctggaccacatggggagctcattggttcaagacacagactccagggctcagctcccaccctcttccagttttcttttccccagatatccttgggcccactctctcataactttttgccatgtctcgaatgtctatgttctcttcagctttcaggtattttcttttattttttaaataaaattaaatccaaattttattaaggatttcaagttacatacttcaaatttctacaatggaatggaatcattttggaactggaaaagtggcataaacactgacatcccttgaaactacaattttataaagaaaattctgcaaaccacatccccattatgtaacaagactaggcattatctacaccttcactttggcaatagctatttcccaaaataatgaaaaaggtgattttgctacttcagttcattaaaaacgggattctatctttaaggttcagaaaaagctgcatttagatgaactatggttacccgctccccccaccccccaaaaaaaagagagcacagagtgtctaagcaaagcaaaggaagtcattttgaaaataaagagagaaaagctattataattggttaaggatttccagtagtaagtgaaaatctcaggagaggaatggatagcactacaaacaatgtgttcacattccaagtccttaacactaactttctctgttctggatctgggcaagcagcactctgttagatctttgcgtggctcctaattttatagaagtggatggatgcactatttcacaaggtctaagagtttttttcagatatttttgatgactgtactgtagtaaatactatagggatagcactatagtattgtagtcatgagactaaagtggaaaaaagactatttttgacaaaagatgccattaaatttcagactatagagccacatttacaatatctcaggctaattactgttaattttggggttgaacttttttttttttttgacaacagcgagggtggactattggattgtcattagaggaaggtctagatttcctgctcttaataaaattacattgaattcatttttagaggtgatgaaaacttcctttttgagaagttagtgttcaggtcttggaatgctttcaggtattttctcatgctgttccctctgcctggattacccttttctgccact

SEQ ID NO: 1908 - DNA, 1550 bp, artificial
  synthetic oligo
gatttctccatggctggggtccctatactgggatgccctggctggattagctgccaccagctgctcgaaggtggattcgcatttctgcccctactgcagaggccatttatcatagtgatgatagatatttaatctgtagcctgagctgcaagcacagtgataactgtagacagaggaaaggtgagattcgtagtctgtgttaatggggctgcctttatcatggccaaataaataatgaaagaagatgataacaatggtgcctttatgatcaccatgaaaagctcttactgcttcagggttctgcactgtgctgggccgcatttaaaaagaaggcaggcagaaagcaagcaggcaaaggggctgggcagggcatcaggccagggacagggcggaggtccccctattggccttagtaagtatggctgcagccaaccctccattcttaccagtgccatcgcgaccacctttaccaccagggcctccccacacccaagatcacatacctgggttttcagggtcttcctaaaggactcccaagtctcctgttgacaaaggataagagaatggccaccaataaatgttcagatgatttaatggctttccgtgggattatttgagacaaaacaaactgggtggggtatgagtcatggagccaatcaggttctgcctttcatagtagatgtcggggagacagactcaaagctgcttctggagcaccggagttctctttacataggacacccgtctaaagttttagaagctagctgagtggagtgaccacttcagaacatttactaagacctccaacatttcttctcctctcttctttactgctttagaacaagaagagaggcaagagagcaagcagtcatggcaaagaacccctagatgtaataggctctcggggatgccaaataaagttatcccctgaattacacagccagctgctaaagggagggcaaatgttggcaggttgtctgggaatataacttgatacaaaacttctggaaggccttaaggctaccacacacaactccacaggacgttctactcaagcccggctatgtaatttgcttggtggaaaatagtagaaggtttgtgagtggagcgctacctttatttgtccacttgcatttggaaaactgtctctttagaaacaccaagactaatatatatttgtgttaacctgtttaaatcagggtcataacggttctggagtaagtggctttcaaattccagttcaatcttgaaattcttgcattgtattttgtgataatagtcttatggataaatggaaatgcaggctacattttcttcaatgcagttagtaacatttgtgagaagccaagctatttggaccatgaggcagcaacccaagcaccatgatttcctccaagtttatttaacttgggacaaagtactgggcagtactccactgtttctgatatgtgcatcttgcagattgaaattttggctgagagggtcaagagcttggctgacaccctcgcacagggcttgcctctcagtgggcccatggagacagtcggtga

SEQ ID NO: 1909 - DNA, 1550 bp, artificial
  synthetic oligo
ccccaggtgtgggcatttctgtccggtctcagcactttctggaactacagcgcatttcctctggtcacttccatatggtcctgtctgactctggaaccttccctgctgaccaccttgtcactggtccccacagaacagcccaaaatcacctgctcacctcttgacagggagcattctgggacagtagaagtcttctggctgtcccatctctcacccaggaagccgtgtgataataagcaaactttttgatataaaattcacatagggacagtggcttttagacaactgggtaccactctggttatcttcaacacagtctccaagtgttttccgaatgggttgagtagagtctgatttgccatattatccatcagtttttggcatgtcaccccgaagttaataggggtttggaaccaccttgatacttgaaattagactttaaccgggtgttttatttggaatccagctctgaacacatacacagatgaatgctttaaaaccaaagcctccctcatgagtattaggtggggaaaaactttgaaaatcctagtggaacaaacatctacatactgaggctgaattcctaaatgcctatagtctcccaggaggtgaaaaatgattccttggaatacatgtcagctccgatgaaaaaggaataattaagcagccttctactgcctcttggatgcttaactgccccatggaaaaatactggctttcagtgtgcctagaggcacccgacaggtgttcaggcatgtggagggtagcagagactcacaggttaagattttaaccaggaatcaaatggaagaaaatattttcggtgtacttggagctaaatgagaagaacttatgaacacaaataaggaaataacagacactgaagtctacttgaggtagggagggtggcaggagggagaggatcagaaaagatatctattgggtactgggcttaatacctggatgatgaaataatatatacaacaaactcctgtgactcttatttatgtatgtgacagaccttcacatgtacccccaaacctaaaataaaagttaaaaaaaataaagggcattgcaaagggaggccttcctgctgagactttcaagattctggacagttgtgatcctacatttgaaagtatcagtcacatattaggcacttgaacaatctggagaacttcaaggcaaatttgaccttctcagaaactcctcctagaaatgagctggatcgtgtaacaccgaattataatatgaatagttgccttttattaagcactttgtaacagtttatgggggagactacagtactcacccacaccttgtcttcctctctttccttgacaaaggaacagcacagttcacctgcagttaggaagagtagtgtgacgactcctcaccactgaaacatgagcagaagcgttgtctgtcacatcccggcatgtgagagccaatgtgccatttccattctttctccctcctttcaatggcaaacatggcagcttcagcttgagatgatggaatcacaaggtggaagtaatatggatccccag

SEQ ID NO: 1910 - DNA, 1650 bp, artificial
  synthetic oligo
atggagcattgtaccaggcacaaagcccggctatgatgacatcaaaggcaccctgctctcttctgttgagaagtgttcaaagtagttagggagtctcaatgagcccatgtagcaggtaagcaatcttgatcgctcacactcaaaaatgcaaatgtatcattttgttcacttatagctagacttaatagggtatccattcaaatgacctgtcattccatcagtgcccacacctggtgactttttccaaggggtccacagccccaccaggattctccccactgtggcattatctccatcacaccccaaggctagatgagaccacagccctccaaggctaaatgagaccacagccctcttggggcactaggaagatccagcttaaaccactgctgaattcaaggtaatttagtggcactgcctcagaacctctctgtcctggcaccccacctagtggcaagggacatatctgcaagactgctgtcttccagaattccagctgggacgcagtcctctatttgaaaacaagttttctggaaggagggagctctgaggaggagtttcacaaggagaagaacacagatttgggataagatggggggacaatatttcagtagggacaatgacagagacatgagtacatatatatatagcaactaactttatatgaagggaaacacacatagacatgtattaaggacacggtgtccaagtcagagggaaaaagaaaaacaggctaattaatgagcagccatcatctgtggcaaagaggcatcaggctctacgctagcctttgtttgctgtctttgacctctctgcacctttgttttctagatgagcaaactgaggcttgagggggttgaatcctttcccccaaaaccacagctgctgggttgaagagttgggattttaaccaggggcggctgaatcaaaaggctaggtctcttccctgagcaaaataatggcatgacaaagacagtactgcagattgtcttgggaaaagacaggacagggaaatcagctaggaggacatttcagcaatctgaatttgagttgaggtggtggcttcagaaatgaaaaagaaaggggtggatgagtgtgaatactgtagggaaagtctgggtgacatataaggcaaagacaaaaaagaaaatgaaaatgacatcaatcctctaaaccactgcatcagaaagataaaggcaaacggtggtggttaaggagaggcttggaagaccagatgactgggaggctgcagggaaaagctagaaatgagggtaactttagctccagatacagcaagtgctgatggcgatgttctttgaaatgggtccacaaacccacataagaatttggagggctactgacagagatttgggtcagcaaatgggtccgatatgtccgagcatggcacacaaggatgatgtctcagcttcacagctgcagctgatgcagaggcactatttttgctacaactgaagatgtggccattccagcggcttccagcatgtaggacgatgaactaagcaggtcatgagacatggagtggagaaaggagcaacctgctgtaagatacttctcactaatggtgatggaggagctagctcaaaaaggggtagcttctgcactgtgcaggaacttgacaccatctggaca

SEQ ID NO: 1911 - DNA, 1200 bp, artificial
  synthetic oligo
cagtttggcaccagctaatgattgtgtccaggggctctggacctgcctctttctagaccaaggagtcctcaaaggcagggtctgctgggagcctccctgtgacccctgcagtaccagcacaggcattcgtgccatgagttgaatagaactgaagagaagggagaagcttcccgggggtgggcaagaggaggcttgagagcccaggaataatgataaaacagtaacggcccagggctaaaggaatcctccagaatccgagttctgtggatctaagttggcctgggactgcctgaggatggggcaggccctgcccagagccctcttggagccagcctccagcacctcctcagcctgaccttccaccttcagtgtttagagctgagagagcaggctacggggcacataggtcagccctgcattgcttacacaagtgggccaagactccaagaggggctgagatttggccaaggtctttgaagaaggaatgcccattcatgaaagaagagctattacaacttctgtctcttcccagagtcttctttccagctcttcctagaaaagcatggcctgctcagtcattctcaggttcctgtgctgagaacaggagtgaggaagggaagctcacaggaatgaagcacccactggccactggagatcagatgggcaccattatatgttggatagtattcctccaaaaaatatgttgaagtcccaacacccagtgcctgtgaatgtgaccttattgggaaggagaacatttgtagatataatcaagttaatatgagatcattagagtgggcactaatccaacatgatggtgtcctcataaggagagacagagacacagacacacgtgggaagacagtcacatggagatggaggcagagacgagtgatgcagccacaagtcaagaacacctggggctaccagaagctggaggagacaaggatcctcctctactcctgaaggagcgtggccctgctgataccttgttcttagacttctggccccagaactgggagataattcatttctgttgtttccagccacccaatttgtggtactttgttccagctatcctagcaaagtcatacagacactttcacaaatgtctcacaacagcctctcagccaggcagagatggcagcattggctccgtcttctcattctaatgtcaactccttgcattacctctccagg

SEQ ID NO: 1912 - DNA, 1900 bp, artificial
  synthetic oligo
cctgaaagaaagacagccgtggggcgtttcctgctggggacaggtggagtgaagtccttgctctccttgcaagcagccgaacattcaaagcgaggctgacaagttcaagtcatcctctgatccttctagaaatatcctgctaaaagccaatcacatgttttctttcaaatgtgtcattttgcacagatgtttaaactctggcataagcagcaggttgcatcagcctctcttacatctaaggcctgcaggatcccaataatttaatgttgaccaaaggaagaaagcctccttacaaagtggcagaaagaagaggatcaagacctcaaggagggttttctcaggacacctactgacagaagcactgtgcatcatacctagcatgtagtaagccctcaacaaatattagctttattattagcattgttagcacagctcccacgaacagtccccgatgccgcatgtaagtggctaactgagcaatttgaacccagtggggtaataatcttggaagttaagagtccgggctctagagtaagacagcctaggtccaaatcccagctccaccactcactagcccttccgtgccatagagtcctcatctgtaaaatggggataataatagtatttacgtcatagggctgtagcaaggatggaatgagatgttttcagtagagcgcttgggacagcacctgacataaaaagcattaagtcaacatggaccctcaaatcacccccttcagctgagctttgtcaaatcggccttgcccatctattaacagaatcttgagcaagtttccgaagttactggtgtcttgcagttgttaaaactcagaccagattaaaatgtcaatctcagactcagtttcactcttccctgagcccctggctgctctgagaccctcctgccgccctaccctgtttgggaaaatcaaaggacactggctgtctcatgggaagggggaggagtgggggaaatacatgagcccttttgaaggctctttgagacttgagtaggtttctgctccttgcctcagaggcatcttaacaaaggtgactcctgacaccttcctgtaggctctttttgcgtgggggatctctttgaggggagctggttggagctccttcctggccttctctgatcatccaacacacactcaaccattcccatactgcctaggtgatgtcatgccctcccgtggcctcaaggggccatcgctagctgcctctgcccctacaagcttggcctctaccctggacggttcctctgagctcctcccctgtggtgtcctggtgtcagctcatcttatccactcggttgccatacaggccccacagcctcactgtctcccaagtgaaaatcagatctctatcctattcccttcccccaactgttacccgtggagtctctaattcctgaataaaagatctgtgcaagtaactgaggccagcaggcccctctgtctctccttcccagcccagactctctttgggcaaagctcattcctggctattatgcacaccaaacaccagtccttcaatttggggctggggcaaacagtttaactctccagtcttaggaggagaggtctcccttgtcgaagatgggagtggaggccagagaacggggagatgaaagtatatcccagccacgtaggaacatttctgctggtgcaagaaacctacatcaaagtggccacaagatgagctaatagaaggtggataaatatgagtccatgtttactgcactttatgtggaatcttgaccatgtagggagggaagggcctgcctgcgccattctcctgctcccacccctttttcccaagctgagcaggagcccccttgggtcttggggttgactttatagcatttgagattcttatctcttccttctagtctttt

SEQ ID NO: 1913 - DNA, 9700 bp, artificial
  synthetic oligo
gggtgctcacagaccccaacactgactctgaccttcccatttcttgagcatgtggcagcttccacacctttcctcttccaggcgcacactcacaatgcccactgagcaccagccctgccagagggtcctaggagcctgggctgcttctggggcagcagcagggcccctggggggcggggttgggcccagctctgggggaggagctcccagctgaggccaggcagcctccagagtctccaggctgaggaccgcgggggccctcggcacggcccctagccggcagtggctgagctgagcttggggggatgagggggcgctgggcagggagcccactgtctccttctcatggcttcccttcctccttatcccaggagcctccctgccggccaactgtactaaaactccggaaaaccatggcggggaggttttccaattagaacattctttttccgacctgtggatgattcttaaagcagcaaaaagccattcttcagggcatgcagggagtatctgccagcgaggccttggctccactcgcgcactcgtgctcaggaggcctggcctggggctgcttcagagccacagacaaaaggcagagcctgtgttgtggggcatcaggtcacacagaccaagactgatggctgagagtttcctgggctcattcgaaccagtagattcaaacggcagtggggatccaggctacaggagtggcagatgtcagaccacctctctccttgctttgtgacaaggccactgctcccaatgagaccactgttcacacagcaaacaatccccaggcatggctgctgtcccttggagtagaactgggctgcctcctcccccaaactgggagccgcaacaggccgggacagggtctgactggtctctggccagggttggggtggcagtgcagtggggcaagtaagaatgtgtgtgtgttccagagagggggaccacaaccccgtagcttggagtgcaggctgagaacagggggagaggagcagccactccacatgctgagaggctggaccagctcctagcaggagagctggttacaaacacaagggcctggcctcacgggttcggggctcaaaggacccatcctacctgcaatcacacctggggacccctgcctccagggcatccaccctgcttggagtcagcagagtcacccagcaagtgtaaaccggttgaagagcttaagaggatgaggtggcagggcgggccccgggaaggaggggattagggatcaagcaggagcccagccctccccgcacatgaacctgagcaccccagcttctctccagctgggcaggggctccatccagagcagctggaaccccaggttctaagcccagctctgcctcagactagctgtgtaatcctggcaacatcttgtccctctgtgggcctctgttttcccatttgtacaactgaagtgttgaggttgcctgcctgtcttcagtcccctctagctgaggacactgcctgggggagctttgcggcctgacagctttcagggcccaacccctctttctccccctctagcctggtaactctttttgttttctgtattttttgtagagacggggtctcaccatatcgctcaggctggtcttgaactcctgagctcaagcggtcttctctccttggcctcccaaaatgctgggattacaggcgtgagccactgtgcccacctcctagcctgggaactctggggctagatcaccttgcttgagttctcttcccagccctggagatcagaatggggcctcccctggagctgaggagtgctgctggccagttctttcccagcagccacctgccgtgctacccatctcattgcttagatgcagcctcccagagacgctgcctccacggcctgcttgtgagctatggcttctccagcacagggctcaccacctgctactccctgcctctacctttcagcctcttgcctgcccagacagcccagcctggccccaccctgaagcccctacctctcacttagagccttgctgagggcctgcttgttggtgggaagagactgtccagtcccctggaggtggcactgctgcctaagctggagggacttcaggagaactctgccagagccagggggtgggagctggcctgtcttggagctgcggatgggtggaaaagtgcaagagatgtgaataggaaaggatagggccaagctcaggccaggtagggacagagcccagcctggaggcaggcagcagccaccacagccttggcctagaacttgagggaggtctaagggaaggttcatgaaggagataatgttactgctgagagaaagtggaggccacctggtgtccctggggaggaaatgtcattccaaacaaagggagcatcttgtgcagcgtcctggtggtatttgagcacttggtctatctgggtacatgtcatttgggcatgtctggtgcttgaagaggctgaagaagccagcaggtgcctgaagcctggctgaggtgactagaggtgccctggcaggcgtggaagtggaagactgttggggcaatggacaggtgggcagggcagggcagggcagttaccattcaagtcaaacccgtttgcaggcaagatcagctgcagggcctggcagcctggcagggagggaggggttcagggaaggctgatctctttggctggagcagtcgtgacagatcgggcctgggcagagactgagtcacctgggacatgggaagagcttgaggccctggggcggcccagcctggggcagtcctcacttgctggccgtgccgttggacaccacatttgctcatgctctccagctgggccccccacccctgactcagggctcttgaacaagtttgccttttccctcttccttgccctacatctcacccatcatgatgtcttctaccttctaccctttcaaactaggggctcttgaagaggactgggacccagacaaagagtatgacacagcctaagtcatacagtaaacatgtttaggaggtaagatgccaagccaaatccatggccaccagtagccacagtggaggaggggaggtgttagttgctggccaccagacaggggcatacaatattggaagcagaaaaatgcttgttggcaagagacggacatgaacagaagtgactttatatacaaccccctaagcacacacagggtcgccttctccctatctcatgaaccccaagaagaaaaggatgaggacagcttccacagcctcactcacccatccatcacttccttctgcaaattcttcggatgccctgtgctggtctccgtgacccagtgatgaatcagaaggggccctgccctcccagagctcaggatctagaacaatagagggtgacagccactatgctggattgatgtcatctgagggaactaaggggtgcacagaaggaagtgatcagctcgactgggtggcaggcaggggaggctttccggacactgggtggaggcttgaagaatgactaagagctcactagcccgacggggatgaagagcattttagggagtccgaggagcaggagcaaacaccccaaggtgagcgccatgtgatgtattcagaaggcaatggaaaaaggccagtgtggctgtaatgtattgaacaaagggaagagtggctggacctgcagggataggtcgtctcaaggagtctggcttttaccctgagagcaatgggaagccatggaggagttgcaagcaggagagcacctgatcatattgacacacgtgaacttttaacctgacctccgtgtagagactgagggaaaggaaggcaagaccagaggcagggggacaccagcaaggaggctggtcttcggggccaggtctggactagggtggtggcagcaggcacagggagaagtgggtggactggagggccatggaaacaccacattggcaggccttgatgaaggagaagcagctggtccattcttttgagcctaccaccctggtaggccaactcctggccaagtccatgccatttcttgggctggcttaattgtctccctgtttgggaggccgtggggtgaggggtctttcctccatgctctctccatccttagccccagcccagggccttgcacacaataaagcactcggtgagcaccaacgcgtgacacaggtacatcaaaccgcattggctctgggagtctggctgtatctcgtcgcccagcctgggagatagccccgtttgctgtgccttgtgagccccgggtccgtcccaggatggccttccacgatgagcggctccctcactcttctcctcctttcctgcctgcaggacttcctggatgatctcagccgccagccccccgcccccctccccgcccctgtctgggatctccatctgtaaaatggatctaggaacggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaa

SEQ ID NO: 1914 - DNA, 1550 bp, artificial
  synthetic oligo
aggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccct

SEQ ID NO: 1915 - DNA, 3600 bp, artificial
  synthetic oligo
cggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttag

SEQ ID NO: 1916 - DNA, 3550 bp, artificial
  synthetic oligo
acttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccagg

SEQ ID NO: 1917 - DNA, 9350 bp, artificial
  synthetic oligo
tggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctctttcagaatctccagggccacccgaagggttcctctgtaccccatcttctctctgagtggggcaccgagcttcgtctgtgctgctgcagaggcggcaatgtcttccatctcaaacttagttggggtcttcacgtctgtgcttttcaccttgattttttcatctactgcgaggatttgaacttctagagaaatcgccttttcaggcttcgtttttggtgaagtcccacgtgtgcacaaaacctttgctggccatagtcggcctttccaagagcataggacgtactccgagtccatgatgagctgggaaaaggtagctaagggaggccgaggggtctgcctgccacaccctctgctaccgtaggtctctcctaaaccaagctactcttcagagcatcctttgccttcagactgcaaagggggtgcagtgtgggtgggctgtgttcctcctcctgaatctccctgaggcacttgaactcgtgtttccaatggacaattctggagtatgctgcaacatggtaaagggagagcggaaatgtatcaggaaagcatcctttcgtgaaacgcgaagcaccctgctcagtgaggttgataaaataaggaaacgtgacaagtgagtcttagacagagggatagacagatggcaagtatttgggatcatacagaaggtccacagaagctttattacacagcaaacccaaggccttctcctaattttaacaattccatcttgaggagcacctgcatggggaggtgggtgtaccagcagggaccccacatttcttactgagtattctgtgcctttgggctccttgggcggaaacctggggaaatgcttcatgtttttatttctagggtgctagtatggacctgtgcttcccaggaagcccgaggaggtctcccacatgcagatgctgggtgtcggcaccatgtcatgtgcaagagcacccagaacccagagctgcgtggcgatcatcctggtgattactggctaccatcggtcgtgaggatcgctgcaggcagcggtcactggctgccatctgcacctctctaccgtggttttaaacttttgcctgccgacaccaaatcagtgactcttatcctgaaaacaagtgtctgtacaacgatgggcaaggaaaattccactgtgaaatgtcagcgtgaggtgaatgcaagtgaatgtttagtaaatggggaaatcttacccagtgtcacatggatcgcagcaggtttggttctgtgagctggatctcttgctgctcacactgcaagcgctggtgtgcagacccttcaaccccactctgtgcccctgaagtgcgctgttcttctggcgacccagtggcaccgcgtgtagatgctcaggacctatgcactcctaatgtcaacctggaaacacaaacacagataggaaattaagccaatcaagtgatttatcctgttcccctccccaactcttgaatgcatgcccttttgaaacagaactgacgtcttcatctcaggcatcacgtagttgtcatctttgttttctgccttcttttgcatctcaaacaatttccctgttatgccacttagcgtatgctagtctttttccatttcagaaccttgggaactagtgctttcccgagagcatccccctaagacagaaggattccatgttagcagtctctctctctctctctcctctctctctctctctctctgtgtgtgtgtgtgagagagagagagagagagagaaatgaaatgtgctcaacgagattgataaaatgaggaaacatgacaggtgagtcttgtcatgttactgtgtttttctgattctcaaataacatgaaatgggttagcatagaatatgagatgtgtagacagacatatgaaaggacatcacgtcacagaatctcagtctacatgataatgtgcccgcttccaaggcattgccgatgcgccaatgtgcacacacacatgcacatatcatcttcaactggagctcctaacctaagagcataactggatacattgtcctgtgaatgcccgtgttcctacctcatttgtgtgaacgtctgtacagtgaggtttccctgctagttccaaactttatttaatgaaatgtcccatattatagaaacgtgcaccgaagatgcaactcttttgtcaatccttcacttcccaccttccacatcgaaatactctgctagcctgttgttgttttctatagccattgtacaatatttggtactgtgcaacattgggtatcatagctcacttacatattttagctcatgcattgtggacttcaaattacaggtttcataggccaataattattttcttaataaatgcatgtatgtgtgtctttgttcacgggcactggtagatgtaatatgaaatgtataatgatgatgagatatacatactttagggaaaagttgtacaaaacctttcttagacgagggtatatgaacgtacaggtttaatgccctcttctttagagaactcagagtactgggttgtcaagcacaagtgtcaactgaggaccccgaacaaaagtgagaaggaatcaccaatgaccctggcacttcaatctccccttaactggacctgccagcccatgtcacaaaacaggtgtgactgggcaccctcaagcccaagtcaatgcctacccacatccccaaatgcagagtctctcctctcttcctctctctctttctctctctctctctccacacacacacacacacacacacacacacacacacacacacacacacacgttggaaactcaaggagcctggcattgatgcatagaatccatgctcactgcctctacacattcctgcaaatgtttctgcttccagtacaaatgctgttttcttctccatttagtttcttattttaaacatagacagggaaacatctaaagggatgtctaaaatttctaaataggaaatatagtaagcatcagcaatcccatcacccagaaatgcttattgcaagtatatgagtccacacactccagaatttttgtcctgtttatacatgtatatttctacaagatatttaaaagcttaaagtttgcacagccatttgaatattcttcagtattggcatctggcaacatctttacaggtgtgaaacagtttaagggactgcctcctacagaccaccaaaatatccattgcagctaagttcggatggccaaagccatgcctccttaagagagatcatcagaagggaagtgtgtgaaatcaaaatatgaaatgttctctcaccacatgcgttggcccatcgcccaaataccttctatcaagggtttgcatatagtcttgctggtgactttctccccatattttgtactaagggaaacacaattgttttccctccctctagagagagagagagaggtaggtaggtaggtaggcaggtagatgggggatagacagatggatagacagatagatagatggatgcatacaggtagagatggatatagattgatgaggttgaatgactcatagggatagataaaaatagatggataaaagatagagatagataaagatatatattagctagaaggtctatagatattcagaataatagagagccagagatagagacatagatggtggagacagatgatgaagagatatatagagagaaagacagttggatatagagatagataaatataattttatagaagatagcggcttgatagatatgaagaatgataagaatagataggtgatagatggatggatagagataaagatagagatggatgaagacagagagatgatggatggacagcagagtggctagagatagagcaagatagctagacaggtctacatctatgtctgtctaggtttacctttacctgtctatattgcagatccagctagatcacgatgtgcaaatattgatctacttccgcataccgggatctatgagataaaaagggaacattcactaagcccaactcagttttgtgagtgaacccaagttctcagactattgagtgagtaggacaatgtgttgaatattttacttcaaaatgaaatcaaacaccacctgcacaatgagactaagcagatgaacataaaaggaagacaggataaatagtgagtctacaatctataacatcacagtccattttaggtccctaaagacattatcagtagagcattttctatttttggtatataacttttattctattccatttgctctttagttgagggatgaaggaactagaagaccgtgagcttttatttctcccaacgacagccatgatttgggggataattattttggaagccctgtgttaattcctttctcaagtgagggttcatttactttttaggaacaagtaaaagaacacagtcctcagcagctcttctcaaagtggggtccgtttcctgacgtggtccccctcccaccgagaggcatgcatcctccctccagcacccctccctagcattaccagagctttgtggagctcccgtcggctgctgggtgtgtgattttagaccttcccccaaacaggtgtttccttcaaaggatgagctggcggcatcctttagtacaataaaggcaccgtgtattaaatggtttctctaaaggaagtacattcttgtgtattcctacaccttccctttgcgctggtgaattgcacataaactttcaacgtaactttagagacaggtctacgctttcctagggtttgcagtgcacttgtagcaccattgggtgagaattggtatcggtccagttttccccttattctgttcactaattgcatgcatcagtagaggatgcaattagtgaacaattgcaccgctctccgacctggagagcagagccgtttggtagacaataggaacacaatggcccgccctggtgaaggagcctgtgtttttcgcttctgtcatcgagaaggggccctcactgattttcactcaattcacctcatcgtagttagcggagtgagaccaggaaattcaccttttacagaacatgggtctcaagggtcagctacgcaggatgagcccagcatgagtcccggcctgctcaaagtgacaggaggccttccagtcctacccatggtagctcctcatttgccggcatcagatttccctctcctaatgtatgcatcgtacgttcttacaatgaggaggcgagcaaatttccatcctgaaggagacctgcgacattcctttgagttcagaaatccttgtggatctctgctttaaaggactgactcgggtgacaatgctctggctcaacaggtgtcacctcaggacagtgagtcaggacagtcaactcaatgccacacacattcacacacacacacagagacacatacttcctcacacacacacatccatacacacacccccaaacacacacacatcctcacacacacacatcctcacacacacatcctcacatacaaacacgcacacacatgcacacgcatccacacacatccacacacacacccccaaacacacacacatccacacacacgcgcgcacacacatacacacatgtccacacacatcctcacacacacacacccacacacatgcacacaccgtcacacacacacacacagacacacatcctcacacatacgccctcacctcccccccgcccccgacacagtcacatcgatagcagacacctactagtcttgacgttcctacagctattccagctgtccgctctgtaaatatccttgcgatgtgtgtctgccgccaggaaagaaacgtttaccttggttgtcatagaaaccgaagtgtcgtcccgaggttctgctggatgacgacttgctacggagagcaggaagcgccaatacatcccccgaggctcagcgtcgatctggagctcactcagtggcaccccgctcaatctcacgcgggaaccaagaaaggattcgcaacagggctgggaattctccttggcctaggcgctgggggcaggggaagtttcacagaacgggtcatggagggaggcaagtgaaggcgtcacaggttctgttctcccttgaggcacagggacgtgggagccaggttccctgaggggccacctttcccaccgccagaacacacgagatcaggtacttttgtgtacctatagcttagctcacaccgagaacatgcggtattcggttttccgttcctgagttagctcacttaggataatggcctgcagttgcatccaagttgccacaaaagacacgattttgttcttttttttacgcctgactagcatttcatggtgtatatacacattttcttcctccactcatcagtcgatgggcacttaggtcgatgccacacgttggcgattgtgaattgtgctgcgataaacatacatgtgcagctgtctttttcacataatgacttcgtttccgttgggtagatacccagtcgtggtattgctggatcgtatggtgtatcgactattagttctttaaggagtctccatactgttgtccataggggttggactaattttgattcccaccagcagcgtaaaagcattcttttccaccacatttgcaccaacatctattgtttattgagtttttaatcgtggtcattctggccggggtaaggtgctatctcaccctggtgttcattggtgtttccttgatgatgagcaatgttgaacattttttcaaatatgtcttgtccatttgtatatcctcttttgagaaatgtccacgtcatatgcccacgttttaatgggattatttgctctttctccttgctgtttttgtagagttccttgtagattctgcatattagttctttgtcgcaagcacagtttgcaaatattttcttccattcttcaggttaccttgttactctgttgataatttctttggcatatttctttcgatacttgtgttgttgtcaaaaatggacttatttttcatggaccatatttgtatgtaaacatgaatgggctgaagattatttttaaattgaaattttcatttaattgatagctcaggttttttcaaaacacttgaacatatattgcatgggtctaagaattgttatttttgaaagaaatatttattgaagtgaaactcagataacataaaattagacatttaagcataccgtttggtggcataaagtaaattcacagtattgcaaaatcatcacctctgtctatttacacaacatttgcatcaatcccaaagaaaaccctgtacccatgaggcagtcactactgattcccgcctccctccttccctggcatccactcatccgttttgtaatcagatgacatgataacaacctgatttctaagtatcgctaatccttaacatttgcttcttctggacattccatagaaatggaatcatagggtacgtgaccttttgtgtctggcctatttcacgtaacatggtttccaagttcatcccacgtcgtaccatgtatcagagcgtcattctttctcacagctacggagtatcccgttaggtggatccatcatgttgtgttcatccatttatctgttggtggtaatgtgggatgctcctatttggctgttgtccatggtgctgttagggacattcatacacatgtatttgcttgaatgtctgttttaaatttttctgcatgtatctaggagtggaatgatggtgtcatatgttcattacttttaacatcttgaggaaacaccaaactgtttttcgtagcagccacacaccattttacattcccgtcagcagtgtataaggcttgcagtttctccacatctttaacagcagcaatttttgtcttcctcttgaaagtaaacaacctggggggtggttagctggtaggattgtggtgtgatttgcatttccctaagagtaatgacgttgagcctatgttctccgtccctatacccttgcacatgcctggatcctattttgcttattgcatgggccatcttttccgtcctcattcatgtgttaaactcctacccacatctcaatatcgatcagcaatatttagtctgctgagtgcttctctaaaagccagactctcaccttgatttctttgagactatgaacgaaacaacaaagcgtgatatttaggccgtcaaatggccttgagaaaattctacaccacgggcttctaaaacagtgagaaaatgttttgtcacgagtctaggtaatcagaaggagtaaattggcagtgatcaaggtggagtagtattagcaatgtgctgttcttagaattagcactgagatgagttatgaaatcttgatgtatctatggtacgtagacatctatgtattacctcttggagcacatggtgaaatctccagatattttcagactactatatgccttttccagtagtaacgtgccattgtgacggagatcaatctgaggcaatgtttaacatgagtaagtgaaacgagagataattttcagtaaagttactgtaggaaaccacattcaattatatgatctcacaaagagtctgtagtacagcaagggctctggcagcctttgcccattgttcctcacccaacacgttggtggcttgctatgagccagtgaaatgctgatggtcacaagcaagtgaattcaaagggaataggatacagtagccttacctttaacctgttactcgcacaggcagtgggaaagcacgatgagagtgaatacagtcttgaagactttgctaaatgtagatgaaagaaggaaaatgcatgattacaaacagaaagaaacttgcagagctggtagcaaacaaagacaggtacgaaagttaaagataattttagaagacgtaaagacaatctatagctgtatctatttgagtccatagctatgtctttatgtatacccacgcctctatctatctagagagagaaaaggatgaaaggaaataatacccgggattttaaatggaatattatatctgcttggtggaattatgtgtgaatttcatttcctttataaattatattttcataacattttacagtgaa

SEQ ID NO: 1918 - DNA, 1200 bp, artificial
  synthetic oligo
ggtggctggtttgatgatatgtccactaaaactctctgcatatcagcacgaaatctgtttcgcttccttatcattcatgtgttcgccggagtggcacttttcatttctttcaccacctggctaagactttggcacaggtggtctagtttggggcctatctcagcttgcaacgtgccctcctcactgagcttaataatttctcccttttgatttaaagtgagagatctgcaattcctcctttcacttgaacctttagaggccatcgtagggttattatttggcctaatttcaattctgtcgtgtcacagggagtagagagaccagagcagagtgagagagatggggagaggccagtcagtggagcagtcaaaacacacacaacattgattgattaagcttgcttcttctagggtgcattttgtggcttcccaatgtgattacaatagcaaaatcaaagagcactgatcacggatcaccaaaacagatatagtcctactgaaaatttgagatgttgtaagaattaccaaaatgtgacacagagacacgaggtgagcacatgctgtgaaaaatggtgcccacggattattcaaatcagggtcattaggaaccttccaaaacaagctgcatctgcaaagtgcaataaagcacaatcaaacaaagtatgctggtagttgtgtgtctcctgtgcaaacatctatctatcatctatctatctatctatctaatctatctatctatctatctatctatctatctatctatctatctatctatctatctctatgcctgtctatctatctagctatctatctacctgcctacctatctacctgtctgtgtacctattatatatatacagaaacactatctctgcttctttgattcagttagctactgcttcatctgcctcattgatttaaaaagacactcttcaatatttgtgtctcctatttctgtttctccctcattaatgtctgctttatatattaacattattacttgttcgtgctttcttttaactttgttttatgtctagcccttgagctagaaatgtcactgattcatttttatactcccattgtcatggttatgagtattcaaagcggtctacttttctctgatcacctctttaaatatatgtcatagattcaaatctatagggtttattataatttatcagaaagtagataattcctcctc

SEQ ID NO: 1919 - DNA, 9050 bp, artificial
  synthetic oligo
tttcataactcatctcagtgctaattctaagaacagcacattgctaatactactccaccttgatcactgccaatttactccttctgattacctagactcgtgacaaaacattttctcactgttttagaagcccgtggtgtagaattttctcaaggccatttgacggcctaaatatcacgcttggttgtttcgttcatagtctcaaagaaatcaaggtgagagtctggcttttagagaagcactcagcagactaaatattgctgatcgatattgagatgtgggtaggagtttaacacatgaatgaggacggaaaagatggcccatgcaataagcaaaataggatccaggcatgtgcaagggtacagggacggagaacataggctcaacgtcattactcttagggaaatgcaaatcacaccacaatcctaccagctaaccaccccccaggttgtttactttcaagaggaagacaaaaattgctgctgttaaagatgtggagaaactgcaagccttatacactgctgacgggaatgtaaaatggtgtgtggctgctacgaaaaacagtttggtgtttcctcaagatgttaaaagtaatgaacatatgacaccatcattccactcctagatacatgcagaaaaatttaaaacagacattcaagcaaatacatgtgtatgaatgtccctaacagcaccatggacaacagccaaataggagcatcccacattaccaccaacagataaatggatgaacacaacatgatggatccacctaacgggatactccgtagctgtgagaaagaatgacgctctgatacatggtacgacgtgggatgaacttggaaaccatgttacgtgaaataggccagacacaaaaggtcacgtaccctatgattccatttctatggaatgtccagaagaagcaaatgttaaggattagcgatacttagaaatcaggttgttatcatgtcatctgattacaaaacggatgagtggatgccagggaaggagggaggcgggaatcagtagtgactgcctcatgggtacagggttttctttgggattgatgcaaatgttgtgtaaatagacagaggtgatgattttgcaatactgtgaatttactttatgccaccaaacggtatgcttaaatatctaattttatgttatctgagtttcacttcaataaatatttctttcaaaaataacaattcttagacccatgcaatatatgttcaagtgttttgaaaaaacctgagctatcaattaaatgaaaatttcaatttaaaaataatcttcagcccattcatgtttacatacaaatatggtccatgaaaaataagtccatttttgacaacaacacaagtatcgaaagaaatatgccaaagaaattatcaacagagtaacaaggtaacctgaagaatggaagaaaatatttgcaaactgtgcttgcgacaaagaactaatatgcagaatctacaaggaactctacaaaaacagcaaggagaaagagcaaataatcccattaaaacgtgggcatatgacgtggacagacatttctcaaaagaggatatacaaatggacaagacatatttgaaaaaatgttcaacattgctcatcatcaaggaaacaccaatgaacaccagggtgagatagcaccttaccccggccagaatgaccacgattaaaaactcaataaacaatagatgttggtgcaaatgtggtggaaaagaatgcttttacgctgctggtgggaatcaaaattagtccaacccctatggacaacagtatggagactccttaaagaactaatagtcgatacaccatacgatccagcaataccacgactgggtatctacccaacggaaacgaagtcattatgtgaaaaagacagctgcacatgtatgtttatcgcagcacaattcacaatcgccaacgtgtggcatcgacctaagtgcccatcgactgatgagtggaggaagaaaatgtgtatatacaccatgaaatgctagtcaggcgtaaaaaaaagaacaaaatcgtgtcttttgtggcaacttggatgcaactgcaggccattatcctaagtgagctaactcaggaacggaaaaccgaataccgcatgttctcggtgtgagctaagctataggtacacaaaagtacctgatctcgtgtgttctggcggtgggaaaggtggcccctcagggaacctggctcccacgtccctgtgcctcaagggagaacagaacctgtgacgccttcacttgcctccctccatgacccgttctgtgaaacttcccctgcccccagcgcctaggccaaggagaattcccagccctgttgcgaatcctttcttggttcccgcgtgagattgagcggggtgccactgagtgagctccagatcgacgctgagcctcgggggatgtattggcgcttcctgctctccgtagcaagtcgtcatccagcagaacctcgggacgacacttcggtttctatgacaaccaaggtaaacgtttctttcctggcggcagacacacatcgcaaggatatttacagagcggacagctggaatagctgtaggaacgtcaagactagtaggtgtctgctatcgatgtgactgtgtcgggggcgggggggaggtgagggcgtatgtgtgaggatgtgtgtctgtgtgtgtgtgtgtgacggtgtgtgcatgtgtgtgggtgtgtgtgtgtgaggatgtgtgtggacatgtgtgtatgtgtgtgcgcgcgtgtgtgtggatgtgtgtgtgtttgggggtgtgtgtgtggatgtgtgtggatgcgtgtgcatgtgtgtgcgtgtttgtatgtgaggatgtgtgtgtgaggatgtgtgtgtgtgaggatgtgtgtgtgtttgggggtgtgtgtatggatgtgtgtgtgtgaggaagtatgtgtctctgtgtgtgtgtgtgaatgtgtgtggcattgagttgactgtcctgactcactgtcctgaggtgacacctgttgagccagagcattgtcacccgagtcagtcctttaaagcagagatccacaaggatttctgaactcaaaggaatgtcgcaggtctccttcaggatggaaatttgctcgcctcctcattgtaagaacgtacgatgcatacattaggagagggaaatctgatgccggcaaatgaggagctaccatgggtaggactggaaggcctcctgtcactttgagcaggccgggactcatgctgggctcatcctgcgtagctgacccttgagacccatgttctgtaaaaggtgaatttcctggtctcactccgctaactacgatgaggtgaattgagtgaaaatcagtgagggccccttctcgatgacagaagcgaaaaacacaggctccttcaccagggcgggccattgtgttcctattgtctaccaaacggctctgctctccaggtcggagagcggtgcaattgttcactaattgcatcctctactgatgcatgcaattagtgaacagaataaggggaaaactggaccgataccaattctcacccaatggtgctacaagtgcactgcaaaccctaggaaagcgtagacctgtctctaaagttacgttgaaagtttatgtgcaattcaccagcgcaaagggaaggtgtaggaatacacaagaatgtacttcctttagagaaaccatttaatacacggtgcctttattgtactaaaggatgccgccagctcatcctttgaaggaaacacctgtttgggggaaggtctaaaatcacacacccagcagccgacgggagctccacaaagctctggtaatgctagggaggggtgctggagggaggatgcatgcctctcggtgggagggggaccacgtcaggaaacggaccccactttgagaagagctgctgaggactgtgttcttttacttgttcctaaaaagtaaatgaaccctcacttgagaaaggaattaacacagggcttccaaaataattatcccccaaatcatggctgtcgttgggagaaataaaagctcacggtcttctagttccttcatccctcaactaaagagcaaatggaatagaataaaagttatataccaaaaatagaaaatgctctactgataatgtctttagggacctaaaatggactgtgatgttatagattgtagactcactatttatcctgtcttccttttatgttcatctgcttagtctcattgtgcaggtggtgtttgatttcattttgaagtaaaatattcaacacattgtcctactcactcaatagtctgagaacttgggttcactcacaaaactgagttgggcttagtgaatgttccctttttatctcatagatcccggtatgcggaagtagatcaatatttgcacatcgtgatctagctggatctgcaatatagacaggtaaaggtaaacctagacagacatagatgtagacctgtctagctatcttgctctatctctagccactctgctgtccatccatcatctctctgtcttcatccatctctatctttatctctatccatccatctatcacctatctattcttatcattcttcatatctatcaagccgctatcttctataaaattatatttatctatctctatatccaactgtctttctctctatatatctcttcatcatctgtctccaccatctatgtctctatctctggctctctattattctgaatatctatagaccttctagctaatatatatctttatctatctctatcttttatccatctatttttatctatccctatgagtcattcaacctcatcaatctatatccatctctacctgtatgcatccatctatctatctgtctatccatctgtctatcccccatctacctgcctacctacctacctacctctctctctctctctagagggagggaaaacaattgtgtttcccttagtacaaaatatggggagaaagtcaccagcaagactatatgcaaacccttgatagaaggtatttgggcgatgggccaacgcatgtggtgagagaacatttcatattttgatttcacacacttcccttctgatgatctctcttaaggaggcatggctttggccatccgaacttagctgcaatggatattttggtggtctgtaggaggcagtcccttaaactgtttcacacctgtaaagatgttgccagatgccaatactgaagaatattcaaatggctgtgcaaactttaagcttttaaatatcttgtagaaatatacatgtataaacaggacaaaaattctggagtgtgtggactcatatacttgcaataagcatttctgggtgatgggattgctgatgcttactatatttcctatttagaaattttagacatccctttagatgtttccctgtctatgtttaaaataagaaactaaatggagaagaaaacagcatttgtactggaagcagaaacatttgcaggaatgtgtagaggcagtgagcatggattctatgcatcaatgccaggctccttgagtttccaacgtgtgtgtgtgtgtgtgtgtgtgtgtgtgtgtgtgtgtgtgtgtgtgtgtggagagagagagagagaaagagagagaggaagagaggagagactctgcatttggggatgtgggtaggcattgacttgggcttgagggtgcccagtcacacctgttttgtgacatgggctggcaggtccagttaaggggagattgaagtgccagggtcattggtgattccttctcacttttgttcggggtcctcagttgacacttgtgcttgacaacccagtactctgagttctctaaagaagagggcattaaacctgtacgttcatataccctcgtctaagaaaggttttgtacaacttttccctaaagtatgtatatctcatcatcattatacatttcatattacatctaccagtgcccgtgaacaaagacacacatacatgcatttattaagaaaataattattggcctatgaaacctgtaatttgaagtccacaatgcatgagctaaaatatgtaagtgagctatgatacccaatgttgcacagtaccaaatattgtacaatggctatagaaaacaacaacaggctagcagagtatttcgatgtggaaggtgggaagtgaaggattgacaaaagagttgcatcttcggtgcacgtttctataatatgggacatttcattaaataaagtttggaactagcagggaaacctcactgtacagacgttcacacaaatgaggtaggaacacgggcattcacaggacaatgtatccagttatgctcttaggttaggagctccagttgaagatgatatgtgcatgtgtgtgtgcacattggcgcatcggcaatgccttggaagcgggcacattatcatgtagactgagattctgtgacgtgatgtcctttcatatgtctgtctacacatctcatattctatgctaacccatttcatgttatttgagaatcagaaaaacacagtaacatgacaagactcacctgtcatgtttcctcattttatcaatctcgttgagcacatttcatttctctctctctctctctctctcacacacacacacagagagagagagagagagaggagagagagagagagagactgctaacatggaatccttctgtcttagggggatgctctcgggaaagcactagttcccaaggttctgaaatggaaaaagactagcatacgctaagtggcataacagggaaattgtttgagatgcaaaagaaggcagaaaacaaagatgacaactacgtgatgcctgagatgaagacgtcagttctgtttcaaaagggcatgcattcaagagttggggaggggaacaggataaatcacttgattggcttaatttcctatctgtgtttgtgtttccaggttgacattaggagtgcataggtcctgagcatctacacgcggtgccactgggtcgccagaagaacagcgcacttcaggggcacagagtggggttgaagggtctgcacaccagcgcttgcagtgtgagcagcaagagatccagctcacagaaccaaacctgctgcgatccatgtgacactgggtaagatttccccatttactaaacattcacttgcattcacctcacgctgacatttcacagtggaattttccttgcccatcgttgtacagacacttgttttcaggataagagtcactgatttggtgtcggcaggcaaaagtttaaaaccacggtagagaggtgcagatggcagccagtgaccgctgcctgcagcgatcctcacgaccgatggtagccagtaatcaccaggatgatcgccacgcagctctgggttctgggtgctcttgcacatgacatggtgccgacacccagcatctgcatgtgggagacctcctcgggcttcctgggaagcacaggtccatactagcaccctagaaataaaaacatgaagcatttccccaggtttccgcccaaggagcccaaaggcacagaatactcagtaagaaatgtggggtccctgctggtacacccacctccccatgcaggtgctcctcaagatggaattgttaaaattaggagaaggccttgggtttgctgtgtaataaagcttctgtggaccttctgtatgatcccaaatacttgccatctgtctatccctctgtctaagactcacttgtcacgtttccttattttatcaacctcactgagcagggtgcttcgcgtttcacgaaaggatgctttcctgatacatttccgctctccctttaccatgttgcagcatactccagaattgtccattggaaacacgagttcaagtgcctcagggagattcaggaggaggaacacagcccacccacactgcaccccctttgcagtctgaaggcaaaggatgctctgaagagtagcttggtttaggagagacctacggtagcagagggtgtggcaggcagacccctcggcctcccttagctaccttttcccagctcatcatggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccat

SEQ ID NO: 1920 - DNA, 1200 bp, artificial
  synthetic oligo
aaccagatccttatctctcaccttatacaaaaaccaattcaaaatggattaaagacttaaacctaagacccaaaactataaaacactactagaagaaaatataggggaaacactttaggacattggtctgggaaaagaatttataaataagacctcaaaagcatagaaaacaaaagcaaaagtagacaaataagattatatcaaaataaaaagcttcaacacagaaaaggaaacaatcaacagagtgaaaagacaacctacagaatggaagaaaatatgtgcattctgttcatctgacaggggactgatatccagaatatacaaggaactcaacagcaaaaatacaaataatctgatttaaaaatgagtaaaaaatcttaacagacatttctcaaaaaaaaacagaaataatcaacaaatgtataaaaaatgctcaacatcactattcatcaggggcatgcaaatcaaaaccacaatgagatatcgtctcaccccagttagaatggctatattgtcaaaaagacaaaaaataacaaatgctgataaagatgcagagaaaccagaacttttatacactattggtaggaatgcaaactagtgcagccactatggagaacagtatggaggtgtctcaaaaaaactacaaataaaactaccacatgatctgtcaatcccattactgggtatataaaaaactacaaataaaactaccacataatccagcaatcccattactgggtatataccccaaagaaaggaactcaatatatcaaagagatatctgcatctccatgtttagtgcagcactattcacaatatccaagatatggaatcaacctagatgtccaataacagataaattgataaagaaaatatgatatctatacacaatggaatattactcaaccataaaaaagaaggaattctgtcattcatggcaacatgatgagcctgggggacattacattaagtgaaataagccaggaacagaaaattaaataatgcatattctcattcatatatggaagctaaacaagttgatctcaaagaagtagagagtagaatagtggttactagaggctgggaaaggtggaggggagagagagtaggaaaggattggttaaaggataccaaatgacagctagatgggaggaatgagttctagtgttctatagcactgtagggtgactacagtcaaca

SEQ ID NO: 1921 - DNA, 1500 bp, artificial
  synthetic oligo
ttgtttgtgccaaacactcactcccaccactcatctgcccctacgtgtgtgggggtgagggggcagggctggagttcctctgcctccttgttttgtcgctttgattttagtgaaattttgatggcaaaattaaatttatttgcaagatacagggctagtcacattttctatgctacttggtgccatttgtagtaagttactttttttcccccacaaaggaattgggaagcttatctcagttttcaaaacttttgataaaaacttgttcacaatattccctctttatctttttaatgtctatatgatctgtagtaatatcctgtccttcattcctgatattgattagtgttcattctctcttgtgtgttgtgtgtgtgtgtgtgtgtgtgtgtgttgttttttgtttgtttgtttgttttttgagacagggtctcactctgtcacccaggctggagtgcagcagcttgatctcggctcagtgcagcctcgaccccctgagctcaagcgatcctcccacctcagcctcctgagtagctgggactaccggcacatgctaacacacgtggttaaattttttgtactttttgtagagaaggggtctcactatgttgcctaggctggccttgaactcctgggctcaggcaatcctcccgcctcagcctctcaaagtgctgggattacaggcataaaccactgtgcctagccccctctcatcttaattagtcttgctagggttcattaattttggtactctttaaaaagcctaatatcggggtttactgattgtcctttttatctctgttatttctttatttgactcattctgtgtttacttttgctctttttcgagcttctttaaatggactgttcggccattgattttatgttctttttttctgttatgagcactgaaagcaagaaattttcctctgaccacttccttccttccaaatggctagtaatttgggtaagttgaatgttttgtgcagtttgaaatatcttgtaagttccttggtgatttcatctttgacccatggatttcaaaatatctagacatatgttattgttattaatttcaaataaaattccactgtgatcagagaacttatgaaaacgtgcgatccttttcagtttctgaagatttttaaatggctcgacatatggtctatctaagtgaatgtacaatttgcccttgtcatgaatccgtattttctacagaggccaaggtctgccccctccaaccactgcaactcctgtcgccattccccacgaagaggcgacctgaagcctttccaattccacctgtagggggccaggctcctcacggcactgccacgccgacagcctccagggggcgctcaccgtcgcctgtaccactggccgccaggcagcctccggctccgcaccccgtgcacccttaggcattggccctccttccagcccatcccccaccgcacaccggggacagtcccttcctgcccccaacgtgcccttccacac

SEQ ID NO: 1922 - DNA, 1100 bp, artificial
  synthetic oligo
ccccaggaagctcacctgggaggtgccacgggcctggatggagggcagcagtggtggggagagctggcccgacgatgggtgcagttaggaggtgacaggggcaggaagcagcgcggaagggctgggggcacaggaaagtggggaagagaagtgcatgcatgtcctggggctgccatcactgagtgccacaagctgggtggcttcaaacaacagaaataacctctctcagttgcagacgccagaagtctgcaatctagatgttagggggccgtgctccctccggaggcctaggatgggatccttcctgcctctcccagcttcagggggctccaggtgttcctgggcttgtggctgcacgtggccgtctcccctgcgtgtctccctctgtctcgtcttctctcttctgtccctcaaaagcacacctgtcatgggagcggggcccagccggggaacccagatgagctcagctcgacatcctcccctgcaatccttacatctgcaaataaggccacgttcacaggttctggtggacataggttctgggggccactcttcacctcattccaagaaaagtcaagggcaattccctggatctggttgggacagctaggtagagatgctggcacacaggccactcacggcaaccagatgctgtagggctgtaggagtcgggctagggagtcaggacacggtcctgggaacagcggggagggctgggggaggctgggtgccaggcgggaggctgaggagggcctgatgaccaccaaggcagggtggggccgcagtggggagggaggcgggggtcgacagacagtctgacccgccattccagggaccagagcctcccgccctgcatccttgcgttccaggaaaaagttaccaggacgtttgggtttaattattcctctttcctctcccccacttgccaagggggcaaaggaaagcagacagcagcctgggaggggctgcccggccgctattccactcccgccacgaggcctgggcagggggctggcggccagtcaagccccagctgcctcagccgcggcctctcctggactctggcgccacccatctcttttcgggctggtggaaaagga

SEQ ID NO: 1923 - DNA, 1400 bp, artificial
  synthetic oligo
gtgggccccgggccgggcgtgcagttatggcttattgcagactgcaaaccacagatacaaaaaccttccaggtacaaggaccgtatttatatgagtattgcccccagaagcagcccccaacttcaggtaagagctgcaaggtgcatgcataatgtgtctcccccaagcagggtgtcgcctcatcgccacttccaagcccccatccaggaacatgcctggctgagacctgagggtgaggtcggtgcagggccggactgcagcgccgcctggctcccctgtgtctccccacacccccccgcacgtgtgctcttccttccaccggcaacttccctcttccctactggtctgctccaggtcacctcctccaggtagccctcccgagcctctggcactgtgcatggccctgcgcccccacggtattcagagctgtttcacccccactgggactcctggaggctgaggccctgagtgacagctcctgggttctcagtccccaagcagtgcaggaaggtactgggtaccagcacctcgggcagcaggcatgccttgagtgggtttctccttttttctgaaacggctttactgagagtggctgtgcttaccacacgatttgcgcattgagcacgtacaaggcaagggcttttatatggtctattcacagaactgtgcaaccatcactcagtcgattgtagaacattttcatcacctcaaaaagaaaacccatacctttaggtaccacccctctagcacccactgcccacaaatccgctttctgtccccacagatgagcctagtgtggacatttcaaatgaatggaaccagaggctctgcggccttttgcgactggctgctgtcactgagcggaatgtttccaaatgcttctctctccacccagactgctagtcaggcttcgctgcctgtcccgctctctaccgacatatttctccacgaatgagttggcagtgggggagggaaagagggtgggacagagatgagaccaggctgccaagagtcggacgctgaggctgggcaaaaggtaaaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggt

SEQ ID NO: 1924 - DNA, 1000 bp, artificial
  synthetic oligo
aagtcagcagagtagagtgtggttcgtgtgaactcactgtctcgggtactcccagccttgtgggctgaagccggggattcttgggaagaccttgcagctcagaagctgagccacctgcacctctgccccgtctacccactgagagaaatggacaacaggtggatttatatcagtctccagcaactcagggaccggtttagctctgcattcatggccccttcagggcacccggaagcactggcagtgcacgtaaatggcagctgatagatggggacctgtgccatggtactgaaggcaaacacttccctctaagcctcttgctgtgactttgcagcaagctccccagcaacgccccgggctgggtatgccaggcagagacctggagcatgcacagggctcctcccttccccaccctggctaagctggcagaagccaggccaagcagcgcctggctggaaagccctcccctgcctgggctccttctgttgggtgggcggtgctggcagtgggcctgggagcctgcggagaaggatcagagccacgcgtcactggggcagagggaagcaggctctcaaatgcaggggaattcgggcatcctggactgcccaaggttgggaaggagacaagtccaaggtcacatggctgagtaggtggcaggacttgaatcagagcaacaaggcaagggtggaaatgccaatggttggggaatcttgggactggcaggactcttttagagcacgaggaggtttccggagtcttggttccaaatcaaagttgtacaaagcgagtatgtccgtgtccttgaagagcaccttatttaaaggggtcctgagccagcctctcttgttctgtaggtgggtctctcagtaagcgagcaaccattttattccagtgagaagttctcccctgaggccacaggctcaaggcactttctccagctgcactgtccaagcagcgattttattagaatgcacttcctcaggtgcaccagccacatttc

SEQ ID NO: 1925 - DNA, 5450 bp, artificial
  synthetic oligo
gtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcaccaggcacaagggtccattccgccccccaccatgggcctcagctccatttctcctggaagcatccaggaccagacactgccacatcttggcttggagccacaggcccaggagagatgggctcaggagcagctggtcctggctcctctggctcctggggtctctgggtaccttcctgtagtcagagggcggctgccagcagatggtcccacgtctggtgcaggagaagagggagggctgtggacgggtagggcacgtctcccacctagtctcatctctccctcctggcctgtggttcatctgcccacaacactgtgaccagcagctaggcttggaaacctctgtcctggggagtggagcaagagtccccccttgtaacccatccatggggccagagggtaagaatgcgctgacctgggggccactgccccagacgcctgccctggtagcccctagggaggcactcgtggctgtgtctgtaggtgggatggggtgggtcagggctcccaggccaccgcctggccctctgcgccccatccacccttccccgaaggaggaagctgggctatagcacaatcgtgggagggggtatctgagatggagacgggcagggttggggtctcccctaagggaggaggggagggggtgagcacacagagcagaaatccaccccttcaggtcctgtccccagcccagctgtgctctcccggtgccttcccagtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctca

SEQ ID NO: 1926 - DNA, 3600 bp, artificial
  synthetic oligo
tggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagag

SEQ ID NO: 1927 - DNA, 13850 bp, artificial
  synthetic oligo
attggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtgga

SEQ ID NO: 1928 - DNA, 6050 bp, artificial
  synthetic oligo
cttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgat

SEQ ID NO: 1929 - DNA, 7100 bp, artificial
  synthetic oligo
acgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactaca

SEQ ID NO: 1930 - DNA, 5150 bp, artificial
  synthetic oligo
ggcatgagggccggaaaatccaccccagcaatagatgtgtgggagactgaaaccagatgagtgggtgccagggccagggagggagcacagggagtgactgctgatggagacaggggtgacaaggatgttctggaattagatagtggcaatggtggcacaactctgtgaatgctttaagtgggtgaattttatggtatgtgaatgatatctgagtaaatccattattttttaaaactaccacatgcaatcgggccactgaggacaaaatcttcttatggggagaaggggtttcacaaggaagagctgggagactggccagcaaagaaagtcggagggcagagcagctggaagaagcgggcaatgttacggagccaggaagctctcagaagggccaagtgaatgcaaggagctgagaaacccagggcgtcagcaggacagccacagcaagggtggccgggctgtcctgggcctccgatagcccagggacgactcctgatagcaaggaggcggtgcgggaggggaccagagtggggtgtaccctcaaagtcctgcaacgaggtcagcgaggtcacctctgaaacaaggctccgctgcgatggttggagatgggggatcctcattgtgggggcgcacagcagccagagtgggagctgatggaaacacctttgcccgaaatctgtctcctaggcagcccctgagcccctcctgtgatgagcagctggctccccgtctcgggtgggtgaaggctcctgcagcaggaggcaccttgtggaagctcctgtcctgcaaccccatggggactccactcacagccactggtcccactgtgaccctctcgctggagcaaagcaggaaagccactggcaaatgatttgcagttccattctcatacacgagaactctagaagtttccacttgccccaaagagcaacattatgcttttactatccttcccgctaagatgctttagctctccggctccatgccacagtctgtctccagggaccttgatctcgccatccctcgcatgtcacacaggtccactctatccatgacaacatgctgacaggatctggggatcaggagcaagtggctaaggaagggagggagggtagaggtcaaggtatcagggagagaagaaggaggcccgtctatagcatgagttactcaattgtcatgcattagtggggccctaaatgtgttattttcctatggcgtatttgtacaaaagtatcaaagtgaggatgtatttgtttcctttcatggtccccccaccctttcctgtggctgccataacaaagtaatacaacagaaatgcactctcttgcagctctggaggccagaagcctaagatccaggtgtctgcaggaccctgttccctcctctgcaggctctgggggaggctccttcttgcctcttccagttcccgggggatctgggtgtcccctggcttgtggcggcaccactgtattctctgtgaatccacgtggccttctcctctgtgtttgtgacttctttccttcttataaggacacctgtcattggatttagggccctaatccaagaggatctcatctcgagatccttaacttaattacatctgcacagatgctttttccaaataaggttccattcactgagttcagagggtttgtttgtttgtttgtttgtttgtttttgagatggagtctcgctctgtcactgcatggtaacccctctggtgctgtcctcaatctgctgagaccagtactgtccagctcctctcttttcttccaagccagctcgtcatattgggcccggatgtctgccatgattttggcaaggtcctgagatttggggcctctacctccacggtcaactcagagctggcaatctgggcttgtaggccttttacttcctcttcgtggttcttcttcatgaagagcagctcctccttgagggcctcgatctctgtctccagctgcagccgagtgacattggtgtcatcaatgaccttgcaaagcccatggatgttgttctccacagactggcacatggccagctctgtctcatacttgactctaaagtcatcagcagcaagacaggcactgtcgatctgcagaacggtgcgggcattgtccacagtatttgcagagatctgagccctcaggtcctcgatggtcttgaagtaatggctccagtctctgacctgggatcccttcttctccagatgctcccggattttgctctccagcttctggttctcagtctccaggctcctcactctgcccaggtaggaggccaggcggtcgttcaggctttgcatggtctccttcttgttctggatgcctcccattcctgccagacccccggccatccccgtggccaggccccagaccccatgccaccctggaagctggtggagcaggacacggagatccaggaaccagaacccccagcacctgcatagacgcttgcctcactgctgaacagccaggggccgtagctgggcgcctggacagagcctagggactgatagttggtggaaaaggtggagccagtggtgaagctcatgctctccggcgggagagtgagaggacaggactcgggctttgccaacgaccaagatgacaatactctctcaattgatctacaagttaaatggaatccttattaaaatcccagctggcttaaattaagaaagaaagaaagaaaaataaagaagaaagaaagaaagagagagagagagaaagaaaggaaaggaaagaaagaaaagaaggaaagaaaggaaagaaagaaagaaaggaaagaaagaaagaaagaaggaaagaaagaaagaaagaaagaaagaaagaaagaaagaaagaaagaaagaaagaaaaaagaaagaaagaaaagaaaagaaaagaaaagaaaagaaagaaaagaaaatcctagctggcttttgtgcagacattgacaagctgatcctaaaatgcatatgaaaatgcaagaaactcagaatagccaaaacaatcttgaaaaagaacaaagttatttttcctaattttccaagactcacatttcctaatttcaaagcttaccacaaagctacaggactcaagtctgtgtggtactagcacaaagatacttatacatcaattgaacagaattaagaattcagaaataaacccttacatctatgatcaattgatttttgccaagagtgccaagaccattcaatggcagaaagaatagtctgtttaacaaacggtgttgggacaattagatatccacatgcaaaagaatgaacttggacccctagctcagaccatatacaaaaattaactcaaaatggatcatagatctaaatgtaagagctaaaactataaaactcttggaagaaaacacaggagtcaatcttgatgaccttggcttaggcaatggtttcttagaaaggatgtccaaagtgtccaacaagcaaagaaaaaactaaattggaaaatgaaaaactgttgtgcttcaaagggcaccatcgagaaagtgacaaggcgacccccaaagtaacagagcctgtttgcaaattacacagtagctgataattgacttgtatctagatcatataaagaaccaatgcaactcaataacaaaaagaaatagcccgattaaaattaggtaaagggattttgttcaccagtaaagggattttgttcaccgctgctctgctcatgttgctactgcagttccgaggcagcaggaagagatgcggcccctggatgtcgccgagctgtcagaaccggaggaagtggaggtgctggagctggaggggggttttgagcagtttctgctcccggtcatccatgagatgccagaggacatcgcgtcgctgacaagcactggcgggcgtacctgtggaagcggagcacgctgtgggagatggacaatatgctcttccagatcaaaacccaggtggaggcttcggaggagcatcctcaaccgcctccacaacccgggcgacgcagtggagggcagggtgaccaagaggtgccagaaggccgaggagaaggccaaggaaatggtgaagatggcagagatgctggtggagctggcccagaggatagagacgaacgagtcgagagcacggtcggtggtttacagccaatggattctggtaaactggtggagattggctgacacccagaagaagctgaaaccagagagcctttggttttctctattttactctgtccacgctctgtcctcactcacactcagttctctgctatggtctgtggttgatgaactcaatatgagttttgattgtttgtgtttttgtctggggaagtaagtttatttggaaaatgctctctcatacaggaatgagggcctagaccacgctcttgcagcagtcacatttgttcctgggctttggttgttatttctaaatgtttgaggtgctttgctctttcttgtgtgatctgatagctccctggaactttggatctgtgtgtgacacatgagcctcattgttggagttctccagctctggaggggctgaaggagccgcaatgattctagaagatgactccatacagcaactactgaagaaaggaccagacttcagctgggaatgtggatgggccgacctggctgggacccatgaatctggagaagagctggagaatggagagtattatctgtatttgaggactttaatttctgtgtaagaccaaaggaggagagacacattttgttcaaaatttaaattttatgtggtacactatctgatataacctgtctagtgagtttgtttggacaacctaattcagctttatctgacatggaacctgaactagaggatgagatcttgatattctgtacaagttgatgtaataccctgatgcatttcggggactcggcataaaatgaaagagatttgcaaagactcttgaggggctgggggatgagagtgtggaactgtacattggaccctaaactggagtggaagaggcatcttcaatgttcatacattgtccagctataagttcatttaagtagcagacctgataaatatttgaggtcaaaaccctaccatgttttttttaaaacttaccatgttaatcaaagtattcatttgcttgaaaagaaaaaaaagttgggtaaagaatctaaatggacatttctcaaaagac

SEQ ID NO: 1931 - DNA, 3700 bp, artificial
  synthetic oligo
tcctgcctcagcctcccaagtagctgggactacaggcgtgcaccaccatgcctggctaatttttttctatttttagtagggacagggtttcaccacgttggtcaggctggtctcgaactcctgacctcaaatgatctgcccacctcggcctcccaaagtgctgggattatagatgtgagccaccatgcccagcccagagtcagaatattcttaattgtgggtcacttgcagaagttgttggggactggcttgtgactctgaagggtgatgtatagaaagaagactcacatggctatctggctattcctgccccacctgttttttatggtgaccaaacagtcgatgagggaaagctcttctgttaccgaattccaactaggaaatgcaggaagaattatagaatcgaatcgaaaaatcaccatttttaaccctaaataatggatctaggtgataaaaacactgggcaaaaggatactagagaattctataaaggccagatcaggccgacaccatctgaatctgctgatcagtcttaccgtcgtcaagaggtacacgaaaaggggctcagcatcaccagctgttagggagacacaaatcaaaaccgcagtgcggtgcatcacacacctatcccatggctgaactaaaccacagcagatgccggagtgggtgtgtggagaaaccagcgctcacccatcgctagtggatatgtcaaaccgggcagccactcgggaaagcagttggcagtttcttacaaaaacacacatctataaaggggtagcacggggtagcagagtggtgaggaaaccgctctgtaatttgattgcactggcagttccatgaatgtacacagtgatgaagttgcatagagacgcacatacacgagtgtgcgcacacaggagacacccgagcatcgatgtcgcgtccaggttccggttgtgcctcgggcgttcaagtagccaatgtcagagggacctgtggggaggggccacagcctcccaggcacttcttaccaacgtcctcgtgaatctaacagtttaaaaagaacaagttaaaaaatattccggcagaaaaaagaaaagtataaatgaaaaatgtgggcgaactgttgatgccagctgatggatccacagggtttcatgaactctgtctttgtttatgtttgaacttttccatgataaaccatttcttaagagtcaccacgaaatgagtgtctggtgaataagtgaagcattcatgaatgactgcagtccaactctgtccttccagagataatgcgagcgagatcccgcaaggggagatgattgctcaaggtcacgcggaacagtcaaggctactgagattccgtctagctctttctcaatgtgtgtttttaactttacacaagcaggacattacttttaaaggaaaagtgaccataaactgagggctgcaacataggaggggggaagggcagagggagacccaggatgccagcttcgcctaggggcaggggcgaggcagacagcctggggaggttagaggctctgctgtgagagggtttctgcaagatgaaatcactcaaatgccggctgtgtttggacatcttgagagaacatttccacacacggatggggtctagggttgagttcgtgatacgagcaaacagctacccaaaggacaatgattaactcctgggaaaacaaaatgcagctcgcatggccccaccgtgagcagcatttatgtggccgcataatttccaagcatggggataggaaggggtagaacagcaaaggtttgggggatgggactgatggaagccttcgaggaggcccccaagacgtgggcggacccttgtcttggcacactcctgcccctacatccttcgggccccagagctccctgacaccactggacccaccgccccccaccactctgcttcctgccagccctccagatggcctgtccttgccccctgtgtttgctccctcctgaggtcagcccctctgcaaggacaccggcccttcccctctggctaggttaggtcaaggacttggcctctccaacgcccactcctctcagtcacaaacagggacacctcaggcaccaacctgtacccgagctcagccacggacacatctgggcccccagaagggccctcagctctccagagccagagcaggcaagggcgacagagcgtgtggctttggcggctgggccaggaggagggaggggtccctactgcagggtttagccctttcacacttcagcagagagcagccgccccgtcagcacccacctgctgctgtcctcagaaatggggtgcctgtcggggtgtgctggtccccaaaagatgtgtccacattctggagcctgtgagtgggacccttttaggaaagagggtatctgcagatgtgatgacagtaagcctacatgacggggggcagggggtgccaaatctaatgacaggcatccttctgagacacaggagagacagagaggagaaggccgtgtggagatggaggcagaaattgaggaagcctggagcccccaggagctggaagaagcaggaaggatcccccctagagactcggccctgcgcacacctggatctcagacttctggcttccagagctgtgagggaagagattgctgctgtttgaagcctcagggtccatagtcatttcttatggcaaccatgggacactcatttggtgagaaaaagccccttgaaacacacaagtggtgggtgccgtggatcaagggccgccaaccacagtcaagccccagggccgctggctgggcagactggaccccacagaaccaagccacatggaacaccccctgacctggaggacaggtccctgtcagaactggctcaggaggaactcactgactgcgagggccgggctgggctgggccaccgggaggaaggctggggacacagccaaggtgggggagggacaggcagactggagccccctccagctacaccctcttgctcacaggaccgtgcctcctagccagacttctggaaagtcttcttgacagtcacctgccccaaccaggtgtcccccccttctccttcaccccctttggacagttcccttctctctcccatgaccctcctccatggcctggtgcttcagctccatgacctctggcttcaagtaagggggaggggcaggagggactgggacggcccagcagcctgttctcagaggctggcaccgtgagcaggagaaatgaagggcaaagccaggagacaccaaatgtaggttaactgcaaggaaggagggaagggaaggccatggcagaggctccattgtgcagacccaccccactgaaggctacaggctggccagagccccagcgcctcacaggcctaggagcccgggcttaccatgaagcccagtagccacagtttctggaccccagggaggtctcacggctgtacaggcactgccacccagggtcctccaggtgccagaggacaagaggttggcgagtcaggaacctgccacagccatgctcgtgctaaggggctcagaggatgcctgggcccaggtgcaccctggcttggaataacctgaccttcattcaggtaaccttccgactccccagctaggatatcaaagtcatggcgacagacacttggtcgagtccactcttctatcaccagcacaggtgcttcaatatgtgttgaatgaatgaatgaatgaat

SEQ ID NO: 1932 - DNA, 2100 bp, artificial
  synthetic oligo
gggccgtgtgcagtgggctgcgggtcccacacaagcctagaaatgggggagcaggggccaccgtgtgcaccattgttggcaccgcgtgtgtggacacattggtggtggaggcagcagcgcggtcagctgaagagcgcgacgcctagagcaagtgaagacgaccttgacaagcccatgatcctgtcaggagatcaatctcccttccagcatgttttcagttttttactgtaaagaattgcaaacacatgcccaacctagagaggatgacagggcacaccggccccgccggcggtcctcacacagccctctctcctctccactccccttaatgtggccccgaggcctggggcctcctgagagaggcacctccatctgccttaagcagggacagggccttccaggcagcaaacccgggttcagaacctggacccttgtctacaccagccagggctggaggttggccctctcagcctggggactcataggggtgcccgaaactccaggaatcagccccctgggcccccactgggccaggtcaaagtcagtgtgggtgggaggtatttgcaagatcgccatgcaggaagtagggtcccagggagaggacaggcccagacagccatcgccgcaggcatctgcccacatggaaagcaaggcggtaagcagaggcgatggaatgtgtgtcaacaccgtgcaaagggccagtgtggccggggctggggcagcgagggcggcagccaggggcctcaaggggcgggcaagaggcccgggaggctgggactgccaggaaggaagccagctgctcagcctggggcgccctccccgaggcctgcccgctccctaccagccagacttctagccaagctccagagctgggagcccagctgcccacctagcatctcacagggatggccttgcacactacacacctccacccaagtggagcaattctgtacattcaagtacaattcagttgtacaattctgtacaattcaagtacattctcaagtgtacttgagcaatttctgatgccgagctcccctgccgcgccacatctatagtggctccaggtgcggttgcctcttctctccacacccctcccgggagcacacacgcaggcatgtaggctgctccaaggggttctggaaggctctggccctttcttcttcagcaacctcctaaggggctgggtgaggagtgagcggccaacacacatacatgcatacacacacacgtacactagcctctgcatttcatatacatgtgaaaatcatttgctccccaatgcaggtaacatgagaggctgggccctgcagctctgaggctgtctgcacaaacagatcctgagagagaatagcctcaaggggtctgtcagcctgtggccaagtcagatggtcacgtcctgtttgccctgggtgactggtccagaggtgggcctccccgtgaggactcgactgctagggccagcaaccagcactgaatgcccgtggcccaggtatggggcagagtgcctccctccctcccccagcaggcctgcctcaccaggaccctctcacccacactctggagggtacacagggccaagagccgggggagggggcaagggaagggattagccccaggcagccagctaaaacggggtccaggagcaaggcggcactgaggggcctcaaaggccagcagcatcaggctggcaaggacgcatacatgagcacacactcggaacacgcgggagtgcctgcctgtgtgcctgcaggcaggagtgtgcaggaggccgtgtgagagcctggggagggctgcgccagtgaacaaggcaggcccatgtgtgtgtgtgtgtgtgtgtgtgtgtgtgtgtgtctgtctgtctgtctgtctgcctgtgcatgtctgtgtctgtgtacacacataagtgcatttgtgcatgacccaggggagcaagtgcgccctgcctcagggactccaggagccgagctggcattcaggaagcatctttaggctcttgaacaaaagggcagcctctgctgtctccctccccacagctccctcctctgaggtggcagccgtgtggcacatcccggctcttcaaccttcagcctcattttt

SEQ ID NO: 1933 - DNA, 8000 bp, artificial
  synthetic oligo
agaccctcttctgttgccaggcgccaaatatcatgaaaactgtaactggttaaaaaaaaatcacctgcataaaaatctttaaaattcatttcaacaacaaaactgtgtatgataaagggtcattccaccaagaaaacatagcaatcttaaatgcgtatacaccaaaccacagaactgcaaaatatgtgaagcaaaaactcataaaactggagggctaggtgcagtgactcatgcctgttaccccagcactttggaagactgaggccggcagattgctttggctcatgagttcaagaccagcctgggcaacatggcaaaaccccatatctacaaaaaaatataaaaatcagccgggtgtggtggtgtgtgcctgtggtcccagctacttgggaggctgaagtgggaggatcaccggagcctgggaggttgagactgcagtgagctgtgattatcctactgcactccagcctgggcaacagaaccagatcctgtctcaataacaaacaactctaataaaactggaaggggaaatagacaaatccacaattatggttggagattttaacacacttctctcaaaaattgacaaaacaactagacagaaaatcagcaaattataaaagaactcaacattaccatctataaacaggatctgatagacatttacagaacactctgcccaacaacagcagaatacccatggggcacatcccaatatagacgatatcccaggcaaacctcaacgaatttaacagagctaaaatcatacagtgtgttcactgaccacaatagaatcaaattccaaatgaatcacagcaaaatctccaaacaccaggaaagtaaacaacatgcttctaaatagcccatgggtccaagaggaagtctaaaggaaaaactttttaaatacaccaaaatagtcaaaaacaaaactacaaaacaggaaaatttgtgggatgcagctaaagcagtgccctgggggacatttatagcacaaaaagaaaggcaattttttctctccctaaaaaggaatcagtttctcagaggcaggttggtgcatgggagagggttgacttgaacaatatctggagagctcaaagctttcaaaaaacattaaaccctgaatatatcgggaagctggaagatgttagagcacttacatttactttcctggatccagacttcacatcgaagagtttaattgaactctgggtctacctccagctggctgaattagtctgaacaagaacaagtcattcagatgttcagagtcttcatttcctcatctgtgaaatgctaagaccctcaacttcacagggatctttttgagttaaacgatagagcacttaagaaagcttcccgaaactcccgaagcactgcattcatttgctagagctgctgtcaaaaaatgctgcacacgggatgtgtgaaaacagcacacatttattctctcccagctctggaggccagaagttcaagatcagggtgtcggcagggctgtggtccctctgaaggctggagggaaaggtccgtcccaggcctctcccctggcttctgtcgggttgtggctgatctttggtgttctctggcttgtggatctctgcctccacagcaagctctatactaaggctgtactagaaagtgttagccttgtctctattgtatcctttgatatatatatacatatatatatagctcaaccttggctgcctccttgccagttggcctacgtggctgagaggcgttctgctgtccccgtccttgtgaaggtatatgcacagctatgtgtggacatagtgtggctgctctggctccggacagggccagcttcctcactgcttccagccccatctcacccagggcctctgcagccctgggagcagccaggctctcggcgcacatctctgagcctgcccaggaggattcgggcagtcacccgagcacctggtccctcacggaggcgcactctgcctgaatccctcctcccagatgacgagcgctcacacgaggcttcggtttcctcagtaaccaaggcctgcagctgactggtcacagaattccagggagaggtgtcccagggaccaccattgtgatgacatggcagctggccctcctcctgcccctgtccccccttattcctctagcgcacgcctagccagcccctggggggtggccagcccgcctcaggccaggccagctgagggagactgggaggcctgtggccagcctggccctggcagccacactctgtgctctctgagacggcgcacagccacctggagcatcatgaaaccatgaagggtgcccaggtgccaggagaagggagcagggctaggccggggctgggctgggaaggccggaggggcctccaacagaggtcagggtgcatttagagaaagggaatggcagaaacaagggactgacagcagcaacagggacccagcgggctccctggagcagaagtggggacaggtgggcaggtgagaggcagggggagaaaaggctcagtgccctcgggctctggggcacgccagtgcacgggagaaagggattccacagcaggcccatgggcctcacccaggaattcccagtcttttcaagacaggacaaggccacagaaagaacgaggccgcatggtacacaccaagatgagggtagggggaggacctgggtagggggaggacctgggcagggaagggactgcggggtgtgcctcgagtgccacctgcgggcatgggcctctctgggccccaatagcgtagccaggcagaaagccgccccagttcgccatgctccactcagaactcggtacccagtgcagtggctcgcacctgcaatcccagcgctttgggaggcccaggcaggaggatcacttgagcccaggagttccagaccagtctggacaacatagggagaccctgtctcaacaaaaaaaaaaaaaaaattgattagccaagtgggtggtgcgtgcctgttgtcccaactacttggagggctgaggtggaggatcgcttgagcctgggggttgaggctgcagtgaactgtgattgatccactgccctccagcctgggtgacagagtgagaccctgtctcaaaaaataaataaataaataaacaacccaccagaaatctgtgcccaggcccgatgccaggcaccctggagcacagaggcatctgcagtgcccatgccctcaccagctggccgatgccacgcgggagggaagcagggcacctgaggggcatgcccagcactgtggggccaacagggaggaggggaggacactgcaggcggggaacacggtgccaggacaccgagccaagaagcaacctgctgaggggggtaaggaccatgcccactgcaggccaaggggtgcctggagggagtggggcatcttgcaaaggctggagggcccctctcaggccaggacatgacacgaatgtggggttccgcatctctctgtcagtgcgccccacagcccatcagaggccgtgtccagctgctcctccaggccccaagcctctcatcgtcatctgtcatcagcggcatccccctcgcacaaccctgtgctcatggacagatgcccactctctccaccgagaaagcattgggagagcactgctgggctggggacaggacctcaaggggttgatttctgctctgcatgctcaccccctcccctcctcctttgggggacaccccaaccctgcccatctccatctcaggcaccccctcccacaattgtgctatagcccggcttcctccttcagtgaagggtggagggagcgcagggggccaggcagtggcccaggagccctgacccactccccacccactgccccatcctacctacagacacagccgcacagggccaccagagcagggatctcaggctctttaattccttccctcctggggtctacacacattgctacggccccatcccagagccaggccgggtgcaaagccctggagacagatgccgctcctccaaacgtcccgtctgctcctcagccaaggacagcagtggtccggggcaagcaggacacaggcattctgtgttgggtggtcctagcaaaggaaagaaaggactctcgtgccagcaccagcattgaggggaggctggaaagatgagtgccctgccaggcagatgtggggcagcgtgtacagcaggagggtgcaggcacataggcaaagatgtgggtgaatgtactttgcacatgtgatggacatgaagtgagggaacagagagaggactgcagcacgctaaacagtgcccccccaaaatatctgtccacctggagcctcagcatgtgaccttctttagaataaggcaagggaacacgcgatatcctgcttcgttctggcaactgcaaggcgcgagttggggctggaatgtgggcctggaggaagtcggggagaggactccggggaagcgagcaggagccagatggctcagggccgtggagctggactttgtccttgaggccacgaggggccactgaagggggctgagaggagaagtggccaggcatctgggcaaggacacttcctctggccttgatgtggaggatgggtgcgaggctggggccgtcgtccaagcgagaggggacagggcctgggtgaagagaaaatccagcaatgtgaggggtgattatggagagagaggaatcaagggcacccccgagtttggggtgtggagggaagaactttgggacatccaggcagcaatggagctacaggcatggaacccaggagacactgatgtcacagtcgtcccccagaagagggacataagaaagagacttgggacaagtggccagagtgagggaaagaaaaccaggagggggtgggcatgaggagggaggccttaggaggggacccaagcaagcaggggcaggtggaggaagagccttgcaggccttggagtttggcaggaggcagatgagtcccgtctggaagccgccacttctcaaggaaggcgatgccagctggcctgggctctggggaggcgggtgggagaacacacagcacccaccggcagcagctcaggagaaaccaggccaaagggggctctcaacttggaagctgtggggtggcacagaacaattttgagatgctcaggccttttagggaggtcaggatgggcaggctcaaggctggtggccaggggatgagggccagaggatggaggacacggggatgggaggagccctgggggataggtgggcttggctgaggagaggacgttctgggcactacacgtccccttttcctgaagacagcctctggacacttctctcccttgcggcctacagagcctacccaggcagacccgatgtggctgtcactgagataagagccctgggcttgtgtctgggacacgtgagtttgagaagcctggaggtcacccaagggaacccacctgggggcagctgggcccaggagcctggggcagagacctggtgtcacaggccagtgtatgagcactggagtgaagtcagccaggcggtgggctaggaggtcccgacactcatccctcccccaaaacaacaatcaataagcgacatgctcagagaaacaggatggcagtctgctgaggatcaccagctcctggtcctacaggtcttcgggcaacatgagaagtgacaagcgacaggtagcaccgacccaaactatgaggacacaaaagacccttcagaggccgagcaagggccttcactgtggctcccttggggcccttgaggttctggctgagctgggccgagaagagggaagtgagcatgcaccagagacgccgcctgccaggagacccggcccaagagcttccaggcagatctccctgccttgcctgtgctgagctccaaagaaccacccaccatccaccatagggcaattctgaccacagccagccagggggcagtgctgggagcaggccaatcctcagatgccaaggagccagcttcagcaccagccatctgtgacacctccctctggctgggctcaccactgcagcgggtagcacaagaaaggcagcagcctgcggcttctgcttggaccctctagagacgggacgcacacccctccaggaagccagtctcaagctggctgccctgccgactgggaagtccacctaggctcatggtcctggggatcccatcctcagcctcccctgctttcccctttagggctgagaagaacaggcagccatggtcctcatggctctggccagctctccaaccacgcatcctgagagctgagccttacaggctgacagactggaccctgggtcaccctcatggtcccagcccatgtcagccacagccgtccttcttggagctcaaaaggcagtgaagaacgagtctcaggccctgctccaggtggtgacagcagtggccaggactgatgactaactcccagagccgcctgtgtgcaccctccttttctctgtataacactgacatggcagtgggcatgcagtgtgcagtggtggaagggagatggctgtggagatggttaccctgtcgttgcaggcagggcagtaagaagccctggaaggggctcagtgacctgccacagcctcccaccgggaaaggccaggctgcatgcctgaccccacacaaggagccttggctgtccccttcccatccatggcatctctcaggcagaggcccactggccctctccgcgtggatgcggttgatccctgggacgtggctgccacctttctcaccttccccctcctctccaccttctctctgcccaggagccggccccgaggtgtgggcaggtcacgtggcaccgcatctgcactgctctcctctctggggccctcgggacccaaatcagccaccgatgtgggaagcaggtactgaggggtaatagccgctctctaaatttagacgggagaactccccagagagctggcagaaatatcccgagccttcctgtggcgaggctctcaggcaggagaatgaagagggggcagcgagaacccggggatggggggcagcagggctaagagaaggtgacagaggagaaggcccacacctgggctggggtgcacatgctctggaccacagccttgaactccaccctggtgggggcggcccacattcaaggacaggccagctcttctctgcaattccggtcgcacccatggctctccagcacccttctgcaaccaggagggagctgcctccttccttgctctggccgggtgggtggcttgccaggtgactgaggcctgagccagcagctcccctcctgcctgtcccccagcctataagaaagagccactcaagggcagaggcagttccctgcggaggggcgccctggccatggggccctggctgctagtctgtggaactgagcacatagcccggtcaccgcccccacattccatacttcagcatcctcatccagaagcaaacaagaagtgcagcaaacagcatggcttgtcctcacggtcacggcaccagtggtgggagggaggagaccctcatctgtccctggagctgctgtcaccattacccaaggggcctgcacacaaggtggaagcttcaggacagctgtgcttccaagggtggcccacgcggcgcccctgtcctggaggccacaagtctccatcagctgggactccttgcctggaaggtgactcgtggcacccacagctgtgattctgtctccagctgtgcccctgatcgctgcagggccttgggcaagtggcagcggtgggcaggagaggtgctgggtgctcccagatgccagagcagcaaggggctcagcagcctgagggtggggatgggtctgggtgcaggaagccaatggggcccaccaggctgggcctttcggtgctgggaggagatggggagtggtggagggaggcagccagacaagccaacaggtgctgtgaccgagcgcgcaggggcagaggcccccgaggagtgagatgagaaaaacccacagcctccaggagccgctctccacccccacagacatctg

SEQ ID NO: 1934 - DNA, 2900 bp, artificial
  synthetic oligo
aaaaaaaattagccaggcatggtggcagacacctgcaatcccagctacttgggagactgaggcaggagaatcatttgaacccgggaggcagaggttgcagtgagccaagatcatgccactgcactccagcctgggtgacaacagtgaaactccatctcaaaaaaaaaaaaaaaaaaaaaaaacccatgtgcatcaaaagacactatcaaagagtgaaaagataatccacagaatgggagaaaatatttacaaatcatatatctgataaggatctaatatccagaatacataaagaacccttacagctcaacaattaaaagatgaattatccaattaaaaaaagaacagaagtttcgaatgaacatttttccaaataagatatataaataataaatacatgaaaagatgctcaatatcattggtcattagagcaatacaaatcaaaaccacaatgagatagcatttcacacacactagaatggctattttaaaaatcacacacaataacaagtgttgacaaggatggagagaaatttgaacttcacgcattgctggtgggaatgtaaaatggtgccgttgctttggaaaacagcttggcatttccttcaaaagttaaacatggagttatcatatggcccagcaattctactcctaggtatatactcaagacaattgaaaatccacatccacacaaaaacttgcacacagttgttcatagcagcattattcacaacagctaaaagtggaaacaacccaaatgtccatcgatagttaataaaatgtggtctatccatacaataaaatattcttcagctgtaaaaaggaatggagtactgatccatgctacaatatggatgaaccctgaaaacatcatagtaagagtaagccagacacaaaagcccatgtatggtatgattccatttatttgaaatattgaaataagcaaatccacaaagatagaaagtcaattagtggttgccaagcactggtgggggggggtgcggtgtgtaaatggggagctactgcaaatgtgtacaaggtttccttttggggtgatcaaaatgttctggaattagatggtggtgatggctgcaaaacactgtaaatatactaaacactgctgaattgtacgttttacagggtgaattttatggtatgtgaattgtatctcaataaaaacaaatttttaatttgaacggaaaaggattgaaaaaactataccagttaaatgttaaccaaaaaaagttatagttgctatgttaatatcagaccaagtagactataagggaaaatcattgctagtattaacatatatcactatattttgatcaaatattcaacttacctaaaatacataccaattctaaactcaaatacactgaataacataacttataaatacataaagcaataattgaaagaactacaaggagaaactggcaaaaagcagttgagcctctactcaggacatcatgtgaggaaagacttggttccctggggtgagggaaactgtggaaatctccacggggtgtgagggaggagctctggagagatgggcatgagcttttgttttttaaagaccagcatgatagtaagcatgggctttttctatttctcaaaagggggcagataatagggttgaaaaatattgaaaaattatcttaaagcaaaaatcagatcctgtcacttgttctgtttaaaacgtccgtggctcccagtgccctcttgagaaagttcactttccaggctgatctctacccacctcctctcacaacctccctcaaccagacgggattctttgttatttctgaaacattccatacttcttatcttgcccacctggtgttggggctagtgatagggatccgtggatgaagctggggtggggtggagaacatggttgccacatgcccagacagtgcctggcaggaagaaacatgtggcttatagtgccaactcagccaccgcctggccagggggcccgacttggtcacttcgtctcttcaacagacctgttgctctcccgggttccctggcagcatcctcaactccctcacaacccccccaccacccccattgagtcgatgaccaagctccatctttccagtagtcccacatctcttgccttgttctccacatggttcaggcttgtctcccagccaccagccctgccctgccccacttccaggccatcgctcacaccgaactccaaagggatctttgtagggcccagctcccatgccccatttccaccactgtgcaaagacctccctggttcccacttaacaggacataaaattgaggcacagaggagcttaaaggcaacacaagccaggtggcatggtggctcacacctgtagtcctagctactcgggaggttggggatgacttgagcccaggagttctgggctgtagtgtgctatgtccatcaggtgtccgtactaagttcagcatcaatattctgggagcagaggaccactaggttgcctgcggaggggtgaaacagcccaggtcggaaacggagtaggtcaaaactcgtgtgctgatcagtagtaggatcacacttgtgaagtgaatagccactgcactccagcctgggcaacacagtgagacctcatctcgtaaaaaaaaaaaaaaaaatggcaacacaaaccatctgcaagaccccaactcaaatccagcgtgggttcccccagcccagggttctctttccttcagacacacagagtttgcattcacaaagagaagtggggaaagaatgccgccttgttttcttcaattccccacacaatcatgtcccaagcaagacctcgcttgcatggatgcaagcaagaggatgcagtggcagagtgtgggttcaaatcctcactgtgccacaagctgtatggctttggctcact

SEQ ID NO: 1935 - DNA, 1050 bp, artificial
  synthetic oligo
cggaagtaggacctaagcagctctgcgggatgctgtaggggtgaaggaaggacaatgaagggtagcagaaggaagcccattacgcacagcgcaggtggtggggcaagcagtgcccacaaggtcgaaggctgcttccgcagcaccctgggacagtatgctgcgaccttcaagtcctccttggggaagggaggcaagtagagaagggacgaatgactaaggaccaagaaggactgaacagactccaccagaattcagggcacgtgccatggggccagcaagggtcagcaggaagcacttctaggaggaggcagctcgaggcaggcgtgcagggtctcctcatgggctcagcggcttatggaagggctgttctgggcctggggaggctacacactagcattatgcccaaatggctatgccccgcaggtgagcgtggggacagaccttacccacagctaagggagcacacggctggccatgcacgcctcggtgggaggcggggaaggcttctggagcaggggacacctggcctccatcaggcaaagggaacagggccaagaaaagacccagggaggctggtttgcagttggaagcaaagcccccagtcagcacagagagggcagggcgaggagacccagagtccgcctagggatggagcaggctgggagcttgtgccagatgagagggcagaagggccctgggcatgggcgcaggtggctgcgcctgcacggagccctctgcttttccgagttgtgcgaatattagcaagtttagaagaactctctgtcctgcattctcacggcggcacctcccaccccgggtttctcacagagatgtcaattctgacggcaaaatcttgtcttagtgcccgcgatacagtagaaccaccgctgtacgagtcttttcgggaagacagctatctgaggagagcccagcttgtcctcggaacccctgtggcctcagcagcggctcctgcattactttttttctatttgactatgtccttgtagataatcattgaagttttctatgtctcccttctccccaaaattt

SEQ ID NO: 1936 - DNA, 1700 bp, artificial
  synthetic oligo
ccccaaggaagaaatgagctcccctctggggaagggctaagggctaccaacaaggtgggaaaatatggggccatgagcaaagaggtatagggccaggcacatggtaaggagccacactgtggcccttctgatgacagcagctcttccagtcctgctcagagccttgcctccccgccccacccccaaccatcctgaggtagcacactggtaaagccacccctgtaatgccccaaccctcggattgcctactcgaccactccagtctctaaaaggcacaaacactcaacatggccaaccccaggcttgcttcccaccagactctccctcctgccccacctgcaaacgtttccacaccctgggagctcgccccaccaagacagaagacctagtccaagccctggccaagcaattccaattggatcaaagacctacagggacaaagcaaaacaagagaacaatatctttatggtgtgggatagagacgaaattctcaatatttcaaatggggaagcaataatggaagagatgtaaaacttctagacgacaaaagacaccctaaacacagtaaaaaggcgggctcagaggagagccttacaatgcatggacctcataatgggttttccagaatatgcaaagaattcctacaaaacaacaagaaaacacagacacaaacaactcaagaagaacatgggcaaaggatatcaacaggtgctcagggcaaaggggacccactagcaagcacttggagccatgagatgagaggagatgcccttcagaaccaccaccaggaggaccaggaggatgtgggcatgaaggccacagtggccaaacaccagggacagcccaaaggtctgccagcagtcgaacaaacaattcctggtattccgcatgtgcagttaatggaggcgcacataatggaggctcattcgtagtatgtacttggtggaaaacacggcagagaggcgagcagatgaagtgcgtaggggatgggtgggcacaggcggcttcaatctgcttttaataccttcttcaaggaaaaacgctcaggccaacaggacccacatcaaggctgggtggcagtgctggtgctaagtgatgcgagatgatgccccatacttctccagatgctacagcaagtccaggaggcctcaagatacccaggctggagctcagccttttatgtgtgattgtctaattacctccctttcattagacaacaaaccccaagagggcttcaccctgagttctacttccatcccaactcctaacagtttgctgaagataaaactttaatatgtttcttggctgaattaaaattttatatatttctgtaatttgttgaatatatattaaggacctgtaatttatctgatctaccttttaaaaaataataataataagagatggggtttcaccatgttgcccaggctagtctcgaactcctgggctcaagccatctgcttagtccccccaaaagtgttgagattacaggcatgacccagcccctgagtctgatgtacccggactctactaaaaatacaaaaattgcccagcacggaggctcacgcctgtaatcccagcactttgggaggccaaggcaggcagatcacctgaggtcaggagttcgagaccagcctggccaacacagtgaaaccccgtctcaactaaaaatacaaaacttagccgggcatggtggtgca

SEQ ID NO: 1937 - DNA, 3850 bp, artificial
  synthetic oligo
tgaggcaggagaaccactggaacccaggaggtggaggttgcagtgagcccagatcacaccactgtactccagcctgggcaacagagcaagactccgtctcaaacaaaaaaagaatcatgagatgaagctgggcgtggtgtctcgctcctgtagccccaagtggtggaggaggtagggggcaggcggtagggctgaggcaagaggatcacctgagcattgggaggtcaaggctgcagtgagccgtgattgtgccactccactccagcctgagcaacggactgagaccctgtctcaaaaataataaaaatttaaaaataaataaataaaaatttaaaaagcaaaagcatgagatggaggagctcacctagggagtgaatgtagtcaagaacaggagaggcccaaggagagtcctggggcaccctgacactgagccggttggggagagagactagaaagtcccgggagggaagccgaggagctgctcaatgcactgggtcggagcccgggaggggagggcgaaggtggggcctctggatttgctaaaaggtgggagggggccgggtggggaagctcgacctgcatcgacacagccttccggagctttttgcagagaaggagcaggttgggttttcaggaacatcagaggggcggctgaataccgatggaagagcaattcgcaaggccagggaaagtgctggcaccgctttccccgcatgagggggacatgcgggcaagggaggggggacacagggacaggggagggggcaacaccgggcaggcgaggcaggcatgacgcgaagtcggccccacgggcagtcgctgtggggcggcgatctcccgctgggcaagggactggcgggccttaggggacgcgggaagcggggcgccctaggcggagagggcggagccccaggcgcgctcgccccgccccctgagcccggagccgcagacaaagagcgcgccgcgacggcggcggggtggctgcggctgcgggagcagggcggaccacactcgtcccggcgccgccacgctggtggctgtattggcaggactcctgcccgcccgccccgccaaccccgtcggaggctgagctctgtttccaggctctgccccaggcaccctcctgcacccagcggtggcaggcgcacagccgggtggggcgcgacgccctcttgctgatcaggaatctctgggaagccgagaagagaggccggagaggctaagaaaacagttgtggcctgggagactcgcaatcccaagtgcttgtcacacggcgcctgcgacccctttcactctcactggcaacgcgcgggatgggaggtgaagccacatcacttccaggggcccccgtggctgccacggaggtgggggggctgccaccttcggactccccttaccccactgctgtagagtaggaaacaagctggggaaggacagagacaggaagttatcctctgcccggggccgagctctgacctgcctgctggctctcagctctgccgtctggagtatccaggacaccttggaagcagttgtgactgtagcttccaggccaagtcaggcatcgggggatctcccaacgagtagagcatcagaggagaaaggagaagccgcaggctcactacattcacccactcagtgacccagcaaagtccccattcatgtttccccagctcgggattttgaaaattgtccgcccacaagcatgtgggaacatctgcagattccccacacctgctctcggggtttctacacacacatgtgcagaagcatttgaaagcaagatgccatcagtcccattctccgtggaaccacaacacccttagcacggaattccgcactcatacaatgggccagcctcacatctccccagctgtcccgctaacacccttatagctttttttaaaaatctaggatttgaggctgggcacaatggctcatgcctgtaatcccagcactttgggaggctgaggcgggcagatcacaaggtcaggagttcgagaccagcatggccaatatggtgaaaccccgtctctactaaaaatacaaaaattagccgggcgtggtggcttgcacctgtagttccagctactagggaggctgaggcaggagaatcacttgaacccgggtggcggaggaggttgcagtgagccgagatcgtgccactgcactccagcctgggcgacagagcaagactccatctcaaaaaaaaaaaaaaaaaaaaaaaaagcgaggcgtggtggtgcagcctatggtcccagctacttgggaggctgaggcaggagaattgattgaacccaggaagcagaggttgaagtgagctgagatcacaccatcacactccagcctgggtgacacagagagactccatctcaaaaacaaaacaaacaaacaaaaaatctaggattcaatcaagaagcacacatattacattcggttgttaggtctctagttattatgtctcctctctaatctagaaaaaaatatatatattttttactttaatgggaatgacttcttggaagagaccagtccttatagaatgcgccagagtctgaatttgcctgattcattcccgcggtgagattcaggctgagcgttttgacaagagcaccttgcaggagatgctgtatgtctcctccccagccctgcatctggcggctggcagggtcaggctgccccactgttggggaggctgtttgatcacatggtccaggtggcagctgccagatctctcctctgtaaagacgcagtttcccttcctgattcacaggtaatttggggtaatatttggagactttgtgaatattctgtccccaacgaccttacatctaatggttttggcatccagtgatgatttttgcctgaattaattactgcattggtggctgcaaaatgtctccaccaacatgttagaattctagcagggacaaagaggtgacaggcccggcaagtagcatggctgcccacgcccccaactgtggcctcctgggcaagccacaccacccgcttccataactctgtgcccaccctttctgcctgggggcaggagagacagaaacatgggagggcttcatctcaaaggcctttgagcacttagtcgggggaggggtgtctgggcgtccatgagagacatgtataccggtaggggtgccggtgacagggaagggggtcagttagctgcacatggcagggaagaacaagttatgtcctgtaaagccctcacgtaggcaacgactcctggatgttctgatttaccctctatgtgtgtttttttaccctctatttgtaaacaatttttaccctctatttgtaaaaaaaaaaaacaaaacaaacaaacaaaaaaaacaacacctcacttcaccacccatgttaatgtggtttggggctaccatagatctactcccggtccctacccaaggccctggctactcacagccagtgggatccacatcacctgggagcttgtgagaagtgcagaatcccaggccccatgctagtggctcagtcagaaagtgcaccttaacaaggacttcgggtggagggtggcgctgtactgactcagagcgcgccctggaggaaccagggcagacctcaacgaaggccttctgcatgagggcatctttctttcccctcacttctccttccctccccgaagcccagggtctgctgaagtctcatcaatccacctggcccccacctttccgggagagcggcggcctctcagacacctccatagtcctggctcagaagcagaaaggaggccgggcgcggtggctcacgcctgtaatcccagcattttgggaggccgaggcaggcggatcactagaggtcaggagtttgagaccag

SEQ ID NO: 1938 - DNA, 9500 bp, artificial
  synthetic oligo
gtacctgggattacaggcatgtgtcaccatgcccggctaattttgtatttttagtagagatggggtttctctatgttggtcaggctggtctcgaactcctgacctgaggtgatccgcccacctcagcctcccaaagtgctgggattacaggcgtgagccaccacgcctggtcaattttttgtatttttagtatagatggggtttcaccatgctggccaggctggtctcgaactcctgacctcatgatccacccgcctcggcctcccaaagtgctgggattacaggcgtgagccaccgcacccagccaatttccacttcttaatgaccaactgaatggcccgagggcagcaactccctcctccacccagtgagatcccgggggacacaccatctgttttccttgtcacaatggccctcggacgcaagcactcttcactgccatttcacagttgaggaaactgagtcactgagccagtgggccatgcagcgacttgcccctggccacacagctgtcagttggtggctgcctccattcctatctccacactgcactgccttctctggcagggcccctgaagtagaaggaaggaaaggacacctttctccccaggatgcgtgcatgtggccatggagttcctgttctaaagctttggtgaggtctgttgctgggtggtaacctgcacatcttcagtgtgcaaagggcaggtgttcatatgtcatacatgaacctggggaaccatcaccaccgtcaggacagtggccatttctatcttccccaaaagtgtcctcatgcccctctgcccatccctgcaaccacgaatctgctctctggcactatcgaatttcatttcagcagactggacagtcctcaggaaccccgagatgagaggggaaagggcattctacaatcttgggacaatgacacaaaacaggatgacctggtccagaagatggcagtcagaattcagtgtccagccctctgttcttccactccacaaggactttctcagagcctgcttcttccccagtcagcttctgcggcagaaccactgagttgactgagagtccagctttcccctggaagggtggaggccagcgtggatgtgctggcagcatctggtgctggtgaggcggggaggcagagtgcccatgccagacccaaatccctgctcacaggaagcccccatgcaagcaggagggagccagagaagccacctggcttggtgggtgggagagcagtttggaggaagacgtcgctgaagaggggacactggctgccagccacgctcccgcactcaagcagtactttctctcccccgcagttgcctacatgttggcgatggtctcccccttacaaaaaggggagcctggggccaggcgtggtggctcactcctgtaatcccagcactttgggaggccggtgtgggtggatcacctgaggtcgggagttcaagaccagcctgaccaacatggagaaaccccatctctactaaaaatacaaaattagccaggcatggtggcgcatgcctgtaatcccagctactcgggaggctgaggcaggagaatcgcttgaaccctggaggcggaggttttggtgagcccagatcgtaccattgcactccagcctgggcaacaagagcgaaactctgtctcaaacaacaacaacaacaacaacaaaaggggagtctgggggaggggcaaggccctgtctgcagtgtctccctgctgaatgccacgcacccaggatggctgccagcaccatgggggctcacatgcaggtgctttaggcaagaatgcctgggagatcaccagaagggctggccagctgtcctttggcctccctcgatgtggacagaggggagatgacaggcggtcctgacccactccccctgtaaagcctgagtaggatgggcgggagaccagtcctaagtaccaggggtttatcccctgaccatctccggcgtgctcggatgctagcaagcacatcatggtgtcagagagggggtgccaaggccaagacaagttcagcagagtgtggaccacgatgagatatatgacaagggggcctggtggcagtggagggacatgggctgcagaaaaggctccggagctggggacatgctgtttcctgccttccattctgggcaaccagcctgcttccttttcctaactcaacacgcagtaatcctccattttcaggggaggtcccagattttccaaactaggaggacatgattggaatataggaatggggctgaggttccgacatgacacacgaaagtgcctgtgacaacccacatccgtggaataaaggaaccatgtggtcatctcactagccacagaagcagcactgcacaatccaatgcctctcatgataaaaacacactaggaatagaatgggaacttccttaccctgataaaggacagctatgaaaaagccacagctaactttataccccctagtgaaagactggaagcttctttacctttaagatgaggaacaagggaaagacattcacaggcacttctattcaacattgtactagagactccagccagagcaaattaacaagaaaaagaaatcgaagggccaggaacggtggtttacaccggtaatcccagcactttgggaggccgaggcgggcaggattgcttgaggccaggagttcaagactagcctggccaacatggcaaaagctcgtctctgctaaaaatacaaaaattagctgggtgtggtagtgtgtgcctgtaatcctagctacatgggaagctgaggcaggagaatcacttgaacccgggaggcggaggctgcagtgagccgagattgcaccactgcactccagtctgggtgacaaagtgagactgtgtctcaaaaaaaaaaaaaaaaagaaagaaagaaaagaaaagaaatcaaagccatccagattggaaaggaagaagaaaaacgatttctatttgccaatgacatgatcctaatatgtagataatcctgaggaatctactaaacaaattatacttaataaacaattttagtaaggtcgcaagatataggatcaatgtataaaaatcaattttttttttgagacagagtcctgccctgtcacccaggctggagtgcagcggtgcaatctcagctcactgcaacctctgcctctggggttcatgcgattctcttgcctcagtctcctgagtagctgggattacaggcacacatcaccatgccccgttaattttttttgtatttttagtagagacggggttccactatgttggccaggctggtcttgaactcctaagcacaggtgagccacccgccttggcctcccaaagtgctgggattacaggtgtgagccaacacgctcagccaatcaattgtatttctatacagtagcaatgagaaggctgaaagtaaaattaagaaaacgattccatttatgatagcatcataaagaaaatactcatgaataaacttaaacaaaagtgcaaaacatcatgtaaagaaattaaagacctaaataaatggaaaacgcaccccatgctcatgaacaatactacccaaattgatccacaaatttgatgcaatctctatcaaaatgccaactggcttctttccagaaattaacaacctgatcctgaaattaatatggaaacttgagggacttagaatagacaaaacagtcttgaaaaagacgtacaaagttggaggactctcatttccttacttcaaaacttactacaaagctgcagtaatgaaagcagtgtggcgctggcttaagaacagacatttttctaaagaagatccacaaatggccaacaagcacaagaaaaggtgctcatcatttagctaacaggaagtgcaaatcaaaatcacaatgagataccacttcacacccagcaggacggccataacaaaaacccagaaaataacaactgttggcaaagatatagagaaattggaacccttatatgttgctggtgggaatgtaaactggttccagccactgtggaaaacagttcaatggctacaggcacacactccaaagaattaaaagcaaggactcaaacagatacaagtagaccagtgttcacagcagcgctattcacaacagcccaagggtggaagcaccccaaatgctcatcaactgacgaatggataaatatgttgtatatcacaaaatgaaatattatttggcaataaaaagaaattgactattgatacatggatgaaccttgaaaacattatgattaatgaaagccagacacaaaaggtcagtttctatgaaatgtttagaataaacaaatccatagagacaggaagtagattggtgggtgccaggggctaggaagtttgagggagaaatggggatgtgattgctaaggagtgcagggtttcttttggggtgatgaaaacgttctggaattactggtgtgggctgcacaaccttgtgagtatactaaaaaccactgacttgtacactttgaaagggtaagttgtgcagtaggagaatgatagctcaatacagctgtaattttggaagtgttgtgagtcattggcagaaaatggcttggaacacaaggctaggctagagacttgggggttcctggcctggggatcccaggcctctgtggattgtagatggaaggcgctgcagatgcacatgtgcttctttctgaaaatcaggcccatgaagtgcctcaccctgacaaggtgcggacgaggttactcaggggggacagggagaagtgccccctaaagatgggggagcacccgtgtttaaggaggccgggaggcaggcacggggtcccagaagctgacctgtcttttggaacaaaagctccttctcctctgaagaggctgggacctggtgatgcgtccacccccagaagcgcagtcccctgggacagctcatggcttgcactgctttccgtatctacttttttcagtcctcttgttttcccttagttgtgaaggatggttctcctcgtaaaatcccggctttgattgggccaaggaggaatgtagaaagtgaaagtttgcagccaaactcccacggtttcaaagggagcccagcaggaaagcgcacagagggcgcatgcggcagtggccctcctcctggcgggtctccttggggtgggcaagtcccttccatgaaggagagcttagggcgcagagcagggagggcccacccaagttcacctccctgaaggcaggcccagcccgacctgccgaggccttcccggagggctgtggggagccccaagggctaccggtgtcgtcccatggctcatttcaggcctggggtgcagctcgggtcgctctcccctatccacacgtccccacgaggttggccttaaatgaagtgcgacaccaatccttctccaggaaagtcaaaacggccccggaggaatcgcttggagaaatcgcttgccgtttgatggaatgactcccgaaaaggaagcaggaggatgggatccagagtccccgtcaaccaaccatcccagccctggaatccaacacggattccacaggacgccctctcggtcgcattcctatcccgctagggggctggcaatggccacacaaggtttccaaacagcgggaacaagagacgaggagtggcagccgggaactgagagggaagaaggcggaggacagcgaacgggagaagccgagggccccgcgcacccccggagaagggccggggagagaggaccaggagctccgccagggtggggcaagatttgcgtccccgccctgcccctcggctcccgcaccaggtggccagaggagctcggctcacagcgtgaagtcagtccccggattcctgggaattctcccccgtgcccagcccctccttcccccgcccccgcccccgccccggagttctcgccgatccctgcacgggttcccccacgttctcccaagccaacacccctcctgcaaagcacttgattccttcccagtccagaccaataaacccgggagttgaatccaggccactaaacgcatacctgtctgagccctgtctgctcctgggtgccttgaccttgacctccctccacttagccctaggaggtctcagcccacagcatccgggacatttctctagacagtctgcagggtgcacacagaaagtacacaaatgcggggccgggggagcctccgcgcacacagagacggggcacaggaacgcactcacgtagtcacgccacgcacaggcaagaagccccgttccgggccgcggggctgggctccaggtccgagctccgggccccgcgtctccttccctccccgcggggccctgctggtccacgccccgcaaagcccggccaggcactgccacccgcagagagcccaacccgctgatcccggcggcgcccactcacccgagacgcctaaggcccgggagcccatcgttcgggcagggccaggcgggagtgggtgtcggggtgggcacccagcccccggacggacttggaccgcgcccggggacgcccacgcactcccacgctccaggcccgccgggatctagattcggcgccccccgcacggcgggagcctggctccctcccccgccctgggtcctgcggggagagcgtgtgcggggaactgcgctcgttgctatgcaacctccatcccgcgcccgccgcaccgcgcctcccgggacggaagcgcgccccacccgggccaaccccaacttcccaccccacccgtggctggttcccacggagcgccaacacccaacagccccaggatgggagggtgcggacggctccctaccttgtcctcctcgagccctcccgctctcccacgcccgccgctccgggcctccccactggcccgctcctccccgcggagggccgcgcccccgccgcagcgccggcggccctacctgcagcatcactttgtactgctcctccggtttctggaccacgcacatattacatcccatgttgctggccggcgagaggaggcggagggcgggaacgggaagacgcctttcactgacccgggcgcgggacctcgggtcccgggccggggccaggggccataccctggcgcggggggcgggccgcctagcgggggaggggggcacgcccccgaggtgggggcagcggctcgcccctcaggttaactcttcgctggccgaggccaggcgcgggcatgctccctcgcacccggccaggagaaaaagggcagcgggggatgggcgggcgcgccgggcgttgccaggctacggccccccagggagcgcgggggcgcgccgggccgccaggggccgtcaggggccgtgggccgcgcgcctccccgcccgcggggcccgccgctgccgctgccgcctccggctcctgcccatggccgccagccccgggagcccggccctcgcgctcggcgccgcggcccggcccgcgacaggggggcagcggcgcggcggcggcccccgcccgcggccaggccagcgcccgcgctcccgcctcgcccggccgcgctctcggagctcccggcgcccgctcttcgtccagcagccgctggccgtctccagctcccgcccgggacgacgggcacgcgagcgcgcccacggcggcgggggaggggcgcgggcacggggcgcacgcgcgccgggaggggcggggaggggagcggggccggctgcgggagggagcggcgggggcgctggagccggcgcgggaagccgggggcgggcgctcgacggaagcgggcgggggtcctaggcaccccacgacacccggcgtccggtcctgaggggcgggcaccaggcgcgttgtctgcgcgatgccgctctgggagagaggggtcctgccaggaggagcagtctcctgggtcccccagagagagtccgcgatttcagcccctctccccggtcttggacgcagcagccctcacgcctctgctccttcctcgggcttcgccttaaatgactgcatccctccttcaactcagccattccctgctgtctttgaaacggacacctttgtttaaaacaagaaagaaagagagaaagggaggaaagaaaagaaagagagaaagaaaaaaggatgagcgaagcgtggggagggggtgggtcgtggggagagtggcctcggaggccttgggacccgggcctgcacacagcactggccagcctgggcccgccgcctacctgttcctcagccccagccctcacccggtccccgctttcacagcccttccatctcttcctcttctctcccaccacctccccgtcttcttggacaagcctggagggagaaggcctttgcctggaaagcagcagcgggtggaagtctgcgttcccagaggctgccccggctgcaggagatcacttggagaaattgctacatgcttcatttccaggtttgggcaagtgagggaacccccagccacacggggctgttgaatcggagcccttcctttcctccctggctcctcgttagaagagaaatcaagaatggcgggcctgcccagaatgtggagaagagaggcgagtttcttatccagggcttctcccagaaagcagaacttgagacaagggctggtgtgcaggttgcaacctgccacccaatggctggctagtcttgaggaatggcgtcatattgagggctcagcatcggtctctgcagctggtggatggaagaacattcactagcggcagtgtctagatgagccgtggtaagaggaagcccttgccgttgggcttatacagagcctccagccctcccaccatggccactggcatcgtgggtccatcgcatcctggggagaagctggctgacctccaccagatggtcccctctgttcgctagcttctggcgcgccccctccacactgcatgctccccagcggcatgggcgcgaagacgagcacggggccccacactctccctgagcactcccgtaggtacctcttcgccaaacctgtctcttcttccaatcttcctccacccgggtccctgaccagtcagcccagccattttccactgcccgggggtcatggacaccttcatctcaggccatttctccctctacaaagtagacaacctagtgtcttgctcccctagaggatgtcccctcactgctgtctctcagggccaccctgcaaagggcctcagtgtgacagcaggtgtttttcctagtggtgacatgagatgaccagtcgaggacctgggtctgagtcagtcatggggacaccccatcaccacctcccatgaggccataggtgtgagctgaaggggcataccagtgtgaaagagccgggtgaccgggggtctggactgcctgggcctcaatgtgccatctccacctcaatattcagttcacaatgggtggcttgggtcacacaggccctggatgccccatgatcaggctgtaagtctctcctaggtcccagtagcatggccacagctatgcttttttcagtggtgagtgagtagctctgccaccgaaggtgtggccctgccacagcctctatggtccctgctggg

SEQ ID NO: 1939 - DNA, 1600 bp, artificial
  synthetic oligo
cattatttggagtccttgtggctctatttttattatattacttttctaatttcatttttattaaattttcttttctccttatgacatgttttgtttgtttttaagacagggtctcacactgtcacctaggctggagtgcaatcatagctcactgtaacattgaactactgggctcaagcaatccccctgcctcagcctcccaagtgctgggattacaggcatgagccaccatgctgggccttgtcctcgttattttttattgagtgctggacattgtgaatggaaactataaatcatttgaggccaaggacaatgttatcttcctccagagaaaatttacatttgtttctggcaggcagctggggcactagaaatcctgatcaccttaatccaattttcagggattgaaagagctcaaatcttgactacagtcccttaggggacagggatgcagtcctttagagggctattctatttccagtttacacttattcctagacctttgggtttccaacccaaagcacgaggagcttactagggccttcttccttggtgagccctgcactctgacttttgacccctcacctcttaagtctgctaactgttctgctcagcttcttgggccctcagctgtctctgctggaattagcggatggccataggggataagcagccttaaatgctgagctcatctctcagctcatttcctttctcccatatcttggtcccatatgcttcactgcctattatcacttggatattttcaagcaaatattttccctgttttactgagtctgtttagttgttctcagtggaggttgtggttcaaattacttattttgtcattgccagacacagaagtcattcagcactaggttttaggctctatttatattgttgagtctacatataatcttgcttccaagtactgcataacactccctaatgttttatctgcttccttagtcactacaaataatgctaccatgacctttgtcatgcaggccattgctctgtcacccaggttggagtgcagtatcatgaacatggctcactgcagcctcaacctcctggactcaatggatgctcctgcctaagcctctcacgcagctgggaccacaggcataagctaccacacacggcgaatttttgtattttttgcagagatgaagtctcaccatgttgctgaggctggtctcaaactcctgggttcaagtaattctcccacctcagcctcccaaagtgccacgattacaggcgtgagccaccacgcccagccaagaatttttgtgatgtatccccaagagcagaattacagagaattaccaaaattacccaacctagtgtatacttaattgatgagatactgacatattgttctccagaatggttgtgttggtctgtatctccaccagcagtacatgagcgctctctagccacacatccctgccagcatttgctattgcctgcatttctaggtgtgtgtgtatttgtcaatctaatgggtatgaagtgatactgttgttttgatttgcgttcctctgataatcaatgggcttgcacatcttgggtgtggcatgtctgctgctggtgctgccaa

SEQ ID NO: 1940 - DNA, 1050 bp, artificial
  synthetic oligo
agagaaaggactgcatatgcccactttatccatgatggctaccattggaaacaacccacacgtccatcaacgggggaatgggtaagtgagtcgcggtgcatgcgtgcatacaatggctactagtcagcatcacagagggaagaagggacacagacgtcaacctggatgagtctcatggaagtgattccagaaagaagccggcacaaagggctccagagcgtgtgcttccatttccatacccgtcaggagcaggcgagaccatctacagccatagacggcaggacagggcttagatctgcagccagggattggctgcctggaggcacaaaagcattctctgtggtgatgcaaatgttctttagttggtccaagttgtggctgcatgtgtggataggcaggtgaaaaaaccaggcgtgcacttgattttctgcacagtaatcctcaataaggacttgtttcacggatttttagggcagtggagttactctgtatgatactgtaagggtggatccatgtcattatacctttgtccaaacccataaatggacaacaccagagtgaaccccgatgtcagctatgggctttagttcatgcgagcttctcactgtggctcaccaattgtaacaaacgtactacactgactcgaaatgttcatcatggggaggcgtaaggggagtgacggggtctgtgggaactccttactttccgctcaatttttctgcaaacctaaaattgctctaaaaagcaaaatgccttaattttttaaaaacccaggaaagcagcccagggccgatgtggcagctccaggtgctcaggccctcgggctgcctttgttgctgttccgccatcctcaacgtgcgacttccctttggtgcgacaaggtagctctccccatgatcacagatcacatttgcctttcagctgtaaggagacagaaagtggctggcacaaggccatgcgtggtggctcacgcctgtaatcccagcagtctcggatgccaaggcgggcagatcacctgagatcagtagttcgagaccagcctggccaacg

SEQ ID NO: 1941 - DNA, 4900 bp, artificial
  synthetic oligo
tggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatctcgtagtcagtgtcaggctgcaggtcccactgcgtgtaggagctctggttgtagctgacatactgtggcgaaagggaagccccacccttctcttctgccagggagagagggtggcagcaggggtgagtcggagtgccaggcaacccctctggcccagagcccccttccccaccacgccccaaggccccctttcacgcttacctcccaaggctttgaacaagatatggaacctgaagttgcactggccctccttggggacccaggagacgacactgtagttttcacccgctgtggctgagatgttgccaaaatctgagatccctggggggatgcaggggaacgaggagagtgtggcagctgccaggaagtctaaggccctccctcctggacccggctggccggggcctccctgttggcaggtcattcctccagcttaccagacaaggccatagtgcctccttcccgtacgatggcttcaccagggccctctttggtggtggcctgaagctggaagcggtaccgcaggtgggggctgagatcggtcaggttgtgtgtccgaagttcggggtcccgaaggttgaaggacagttgccccttgcccccctcatccactgtggggacagacaggggttggctgtggctgcagctctgccccctccccgtggcccctccacctcccttccctgctggggcggcgcacgcacgggggtggtaggagagcacgtagccggtgagcacgccgttgtggctgagtgggggctgccagcgcagcagcaggctggtgttcgactggcactccaggtgcaacgcctcggggtggccaggcactgcagggcacagaaccgagtggcaggtaggtcctcgcccaggtctggggaggagggcaggggatgaggcgtggggtgcaggactcacctccctctggggtgctgaaggtgaactcgctggcgggccccgatcctcgcccgttaaaggcctgcacctccaggtggtaggagctatagggccgcaagccactgaggatgacactggtggtgttggcgggcaccaccacatggtctttgtggatatgtctcttgctgtgcttcctctgactgccctccctccagtacgtcacctgcacaagcgaacaggagacctcgcaggggcagaaggcacccagcagggcccccagcgcacacccccaccacccttaatggggaccctcctctcaacccaagtcttccaggagagcggctggcaggtggcaaagccccctcaccatcctgtcgctttacctcagtgatcaccctcctgggcccccatgccttcaacccttacattgtatccgcggaggtggcccttgacctgggccaggtccaccggccgccacttgaccagcacggcacttgagttgaggatttcaatgccttccagctcagggattgcctgggggtctggaaaccaccagtgacttggatagagccataggctctcaccccagccctgaggccaggcccaagcccctacacacagagaagacgaattcggatattttatgaggtacagtttgaggaggagaggtgtgtttgcatggtctcaagatctcttcctggactgcttattagttgcaaaggtgaaaatagtagcttatacaaaggagaaaccatggctgggcgtgatggttcacacccgtattcccaacactttgggagacagaggcgagtggaacatttgaggtctggagttcgagaccaacctgatcaacatggtgcaaccgcatctctactaaatacgaaaattagttgggtgtggtggcgcgtgcctgtaatcccagctaatcaggaggctgaggcaggagaatcgcttgaacccgggaggcagaggttgcagtgagccaagaccgctccactgcactccagcctggatgacagagcaagactccatctcaaaaaaaaaaaaaaagaaagaaaagaaaagaaaagaaaaaagaaaagaaaaaaaggagaaaccagaaaaaaaacttgaccgggtacttcaagttaccatctggtcatgttccagattcaaggaaatgaaagaagcagcattggctgatataactggaataccgctgccaattatagaaatgtgaagtgtggggaatttcataacgtcgctctggttatgtaagagaatatcctcatccttaggaaaggcgcacaccaatgctgagaggtgtggacatgggctggggtggaagcaggcgagctcaaccgtgggcgaggggccctgccggatactcacagtcctctccagagtagccgatagtgacctggggctctggtcccttgccctggctgttgacggcctggactttgatctcatagggcacgaaggtggacgtgttggacaccaccaggaaggggtcgctgacaatctgctcctgccagggccctcgtgtcccctgagggcgccactgcacgcggtactgaacctggggggcgttccagtccatccaccggagcggctggaggaggccagcagaagagga

SEQ ID NO: 1942 - DNA, 1250 bp, artificial
  synthetic oligo
gaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcc

SEQ ID NO: 1943 - DNA, 3500 bp, artificial
  synthetic oligo
ggtgaagccaggtgccacatcgtgaggacactcaacagccctatggaggagctcacatggagagaaacaaaggtcttccgccaacaaccatgagtgtgccattttgaaaaggatcctccagccccagccaagcctttgcatgactgcagtcatggccagaatcccactgcagcctcacaagagcctttgagctagaacaatccagctaagccactcctgaatcctgacccacagagattatgagataataaatggttactgtcattttgaactactgcatttgggggtgatttggtttgcagccacagatcactaatacatcttccctcctcctacacaatgcacggcctgggataacatactagccacatgaggtgggccctattatcatgtaggaatgaggaaggcagtgagctcagatatgtggacaggaacccaggcagagtcagccgtctgagctttgggaagcctggttttcagtagctctagggacttacccacacccccacactcccacccctgaactgctattatggtgctgtagcccccacggtgcctgtcactacccaccagctgctgtcccctctcctctgtgtccatcttttcttcatgtctttgcttctcctggcattctcctgctttgtgacaaatacccgtggctttttctgcacatgtcttttggcttctaatctcactgcagtttcaattccaagagagagaaacttatgggcccaaatactcattatcctcattttggtggagccttcatgccaggtaacttcgtaggcaactaaccagcctatggactagctagtcttggccaggtgcgggctcctggtccaggcagctgaggccaaggttggttcaagctgtgtgataggcagtatggccatctgttatggacttaatgtgtgtgtacccccaaaattcgcacgttgaagtcctaacccccagatggagcagataaagaagaacagagaggctggacatgatggctcatgcctataatcccagcactttgggagaccaaggtgggcagatcacctgagtccaggagtttgagactagcctgggccacatggtgaaaccccatctctacaaaaaatacaaaaaattagccaggcatagtgacacacgcctgtagtccgttactcgggaggctgaggtgggagaatcacttgagccttggtggggaggctgtagtgagccgagattgcaccactgcactccaacctgggtgacagagtaagaccctgcctcaaaagaaaagaaagaaagagagagaaggaaagaagaaagaaagaaagaaagaaagaaagaaagaaagaaagaaagagaaagaaggaaagaaagaaagagaaagaaagaaagaaagaaagagaaagaaaagaaagagagaaagaaaaagaacacaagaaaagcactgttccctcccctccaccactgcccctaccatgtgaggacacagtgagaaggtggctgtctctaaaccaggaagacagccctcaccagaagtggaccctgccagaccttgatctgggacttccaacctccagaattgtgagaagataaatttccattgtttaagccacccagtctgtggtattttgtgatggcagctggagctgactaagacaccaccaatgggtaagtcactggctagtggtgctgctgcagcagggagtatgtcttggtgggcatcttgctcgacctctcctatctaaccacactgaagtcatgcattcccttgtttttctttatactaggcccacgaaaccccatgctttgaaaagaattgcttgtttgccttcaccactcctcctcacagcctggaggtgatcatgttactgtgtagactggtatccctagggacttatgggctccaaacaagctgcccatgaatatcacaatcctgtcacatgcccttagccagccctgcttcccttccacgcagtgcaccggctgggtgcagtggctgatgcctgtaatcccagcaccttgggagaccaaggcgggcgggtcacttgaggtcaggagttcgagaccagcctgtccaacaaggtgaaaccctgtctctactaaaagtttaaaaaaaaaaaaattagccgggcatgatggggcacctgtaatcccagctactcgggagactgaggcaggaaaaccagttgaacccaggaggcggaggttgcagtgagccgagatcatgccactacactgcatcctgggcaacagagcaagactccatcagaaagaaagaaagaaaagaaagaaaaggaaggaaggaagaaaggagaaagtgacagattaagcacatacattcactttctcttcctcatgaaatcccaccaaaatgacagtaaatgactttttaaaaagaaaaactcccaaggacagaaataatgggaaaatagaaaacagcagcaaaatcatgggagctgaatttcactgcggaacccacacgcatccagaaaatgggggtgagtatggaagtgccattaaaagtctgttgaagaggcagtcagatctccacatgcttttccccatcccaacggaacagaatgtttattctttggagatgatgaaacaaagagtgtttcaagtggggagtaccaggaacagcttagatggcaccatactaaaaatgagggggttaaataaatatttacctactgaatttggaccactttggaccctcctggcccactctgtttctcaagtgctgacaaccagcctcaggcagcaggctaaagatctatctctgggtatttggccatcccaaggtgaacgaaaaggtagtaaaattggggttctccaataaaaccagccccgctacatcatcctatgatgaagctcatagttgacatgtccttccttttcaatcagctcattagtgccccattctttttttttttttttttttgagacagagtttcgctcttgttgcccaggctggagtgcagtggcacaatctcggctcactgcaatctccacctcccggattcaagcgattctcctgcctcaggctcccaagtagctgggactacaggtgcgtaccaccatgcccagctaatttttgtatttttagtacaaacagggtttcaccatgttggccaggatggacttgatctcttgacctcaggtgatccgcccacttcggcctcccaaagtgttgggattacaggcatgagctgccatgcccagcctgccccattcttaaatatgagaagacaaccaaggatcaccagacacctgaggaaaacctttagcatgaaagcaggaaagatcaaaatcaaaacaaacaggaaaacaattgttgggaaacacgactatgagaggtaataatttttaaaactaggctgggcacggtggctcacgcctgtaatcccagcattttgggaggccgaggggggcagatcacaaggccaggagtttgagaccagcctgaccaacatggtgaaaccccgtctctaccaaaaaatacaaaaattagctgggcgtgg

SEQ ID NO: 1944 - DNA, 1750 bp, artificial
  synthetic oligo
tgggaggctgaagtgggaggattgcttgagcccaggagtttgagaacagcctgggcaacatggaaagaccctgtctctataaaaatacaacaattagctgggtatggtggtacatgtctatagtcccagctactcaggaggctgagatgggaggatcccttgagcccgggaggtcgaggctgcagtgagccgtgatcatgccactgcactccagcctggctgacagagtgagaccctgccttaaaaaaaaaaaaaaaaaggaatttgggaagggctcacctgggcagtcctggcccaggtctttcatgtggtggctgtcagatggtggccctcttcatattgcctcagagccttttttttttttttttttttgagaaggtgtctcactttgttgcccaggctggagtgcagtggcggggtctcagctcactgcaacctccgcctcccgggttcaagccattctcctgcctcagcctcccgagtagctgggattacaggcgcacgccagcacacccagctaatttttgtgtttttcagtagagacagggtttcaccatgttggtcaggctggtctctatctcctgacctcttgatccacccacctcagcctcccaaagtgttgggattacacgtgtgagttactgtgcctggcctcagagccattttctgtggtccttccatgatggctgaattgggcttccttatagcatcagggaagttggaatgcttacatggtggctaaaggcttgaagagtgagtgtccctgttaacaaggcagaagctgcattaccttttctgcactagcctcagaaatcaatcagcaccacttttaccatattatcttgagtacaagaaagtcacaagcctgcccagattataggggggagggttaaattccacctcttgatggggaagtggcaaggttccaggagagcatgtgggatgggagatattgttggggctacctttgaaaaacacaatctgccacacacaccagttaaaaggcagagactgttgggctagataaaatagctatatgttatttacaagaagcacatttgaagcataaagacacagacatgttgagagtagaagtatggaaaaagatataccaagcaaccactgagcataagaaagctgccatggcatcatactaatatcaggtagagcagaattcaagacaaagagtttactagagatcaagagagacatgtcataatgaaaaaagaacacataatcaagaaaacacaaccatttcaaatatataagcacctaatctaccaaatatatgaaacaaaatttataggactaaagggttctagatacagataaatctccaaacatactggccaactttaacattcctttctcagtaaatgataaaacaaataggaaaaaaatcagaagaatatagatttgaacaacactatcaacctaattgactcaattgatatgtacggaacactacatccaacaacagcagaacacatattcttctcaagtgcagatggaaccccaaccaacacagacaacttctgggcaatcgagcaagcctcaataaattacaaagggtcaaaatcatacaaagtacgatttctgaccaaaatgatgttgaattagaaatcaacaacaaaaagacatctaggaattttctaaatattttgaaatgaaaaaatatctacttccaaataacccaagaaccaaagaagaaaccacaagtaaaattattggtagaacatatctttcactg

SEQ ID NO: 1945 - DNA, 1300 bp, artificial
  synthetic oligo
ccctctgcctcccatcagcacacctaacatctcttcgatctgagtcatacatttctttttttttttttttttttttttttttgacacagggtcttgctctgtcacccagaatggagtgcagtggtgcaatcatgactcactgcagcctcaacctcccgggctcaagggatccccgctcccgctcagcctcctgagtagctgtgactacaggcacgcgccatcacgcccagctaattttttgatgtttttgtagataccgggtctcactatgttgcccaggctggtctcaaactcctgagctcaagcagtctgcccacctcaacctcccaaagtgctaggattacaggcgtgagcccccacgcccagcccatttctgctgtttcatgcattttcgtctgcctcctcactgtggctcccctgacacacacatccgaacctaactttcccacgggtcagggatctcctagaaactgggtatctcggctatggccactctcagtagagacatgccgagaccaaattaaaaagaaaccataatgataaaaaccacaacagccctcctgaaagcaaacggatttaactgtgataaacagcacaggacttgcagtatggattctcagtttgtgatgcaccagaggggacgcaacagtcacagggagcctggctggttgaaacacttctgtgtccagatcatgtaaaagttttgaagaagattttacggaagtatatgtttttaaaatgccatgaactcctgtgtcccctgcatctaacttagccacacagccagggtgtggtgaaatgctctcaggtccgcacttagcagccacgtagcctgcttgtgcctctgtgagactctgcttccccaaccataaagtaggcgtctgagggccaaagaacaaggctgcttaacctggtgccccagctcagttacgagcccgtgacaacagtgaaaaatcatcagcagccctttctcctcctgtagacctgcttgggccctgtagacctgcttttctgctcacgatgaacattagtaagggtaggctcgctgctgcagcaaacaaccagacatcccatgtcacagtccaatggggggtaccgggtcagaagtgcaggcttctagaatttgcagcaaaagtctgagagggggagagacagaggtattgccctgctccccggtagtcaccgctgtatcaagagggggcgaaagactcggatttgacaggggttaagagtttacctgagcacagcattctcattggcccctgtggcttggaaacatacggggaagtttgtaactgcc

SEQ ID NO: 1946 - DNA, 1850 bp, artificial
  synthetic oligo
acataagtggtattcgaactctctgccacctctatgaattgacaggaaaacatctgtgacctctcttgctgaccgagtcacgggtactgctaatactgccacgttcataatggaaggaaatgtccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccg

SEQ ID NO: 1947 - DNA, 11150 bp, artificial
  synthetic oligo
gggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacgtgccttctgtgtgaatcagtttctcagtggtcagttcctaaataaggaaagagcttttatccaaaccagaaagagtgagccatggcccccaccagtaaacctgggaaagaataatgggctgcagaggaagcactcgctcgaggacagcacctggcctgaaaagctgtccctgagctgacgccttcctgtcagctataagcacataaagtatgtggctagaggccaggcgttg

SEQ ID NO: 1948 - DNA, 3750 bp, artificial
  synthetic oligo
ctgtctgagctccaggaagccactgggccccgccactgttcacctgaggatgggctactctcactgacagcagatggttctcaacggaagagtctcctagacggggctgctctctggatttctgcccctcccaggtcaccccaggcctcctctccaggggtgctcaggggagtgagaaaagccgggcatgccatgctctatgccaggatgtgctctgtgccatgggctgtggtaaaaaagaaatgccagaagccacttcaacagcaaagtactcaaagactgatgaaattatgatttattttagttagattttatttttgtttatgtgtattattactttctgttattagtattaatctataattagttaaattagagcgcattcatattgcggaatgcagcagctacaaagaatgaagtaagccagtaagtgctgactgaaaaccgctcccagacatttcgttaagtaacaaattaaattactgcaataagggtgggaagtttgtagactatgatcccattgaatgtttgcagtgggtgagtgtggtgtttgtgcacatgcacgtgtgtgtatgtgtgtgtgcgtgcgtgtgtgtgaacacgtgtgtgcgcgtgagtgcgtgagtgcgtgagtgcgtgtttgcatgcacagtaccaagcagggaagaaaatgtccctggcagctaagaatggttctctctggagagtggggaaagacggaaggagcaggaaccttcactctgactttcatgtcttacttttcaagcgtctgcatgctgtgtgacttttaccttcctttttgtgtctttcagtgttttcaaggtttagggcccaaaggaaacaaaacacacaccatgtctccgcagcatggtgcagagaaaagagtggacatgatttgacgtggcaaagctatagccaagggcacgagtccaaggaagacacacatgaacccagaaagcaggttcttgcctacccgcagggagggccggccagggacaatggaggggctgggggaggctgggctgggtcgcaggagggggctgggctctcgctggagggaacccctgtctggagggaggccggtcacccttccctctgccagtccttccaccctgggctcctgtgaccatagcgagaggagatgccagaggggaagcccaagctgggctgggctccgtcgggacaggggacctggggcaggagccagtggcgggggcagtagcaggaggtgggtcatccaaggaagaaggcttcctgacccagagctctaaggcgaggagtgggcacatggccctctggggacctgtccagctcaaagactccaggtgcccttcaggtaagtaaaacaaccaagtaatcctcagtgcaacgcgaaagtggctgggaagctggaatcacagtcaccacctatgctgagcaaaaccatgattaaaatgggttttctgctttcgctgaacccactttgtggatcagtggtcctagtagaaatggctcctgcagttgacagctccactggcactgaactctccttgattcttgctttgctgaatttcgagaatcttttaagattgctgggatagagggacgcacggggagaaatagcaggcgaaacaccaggtcctgccaagggaaggaggaaacaaacgcctccccgagggatgccagggaaacagaccagccaagggtgtggtcccacaccaggtgcttgagcccctgttgtcctgagaccattccctccctgactctctcctaactctgtccccgtcactcccactcggcgacctggctcgccctttgccctctgctcttctcactctatgcctgaccctgcactaactgtagaaaatgcagaaatgagaaacagacattcattcaacaagcatttattcttatttatttatttatttatttatttatttatttttatttcttgagagatggggtctggccctgtcgcccaggctgtagtgcagtggtacgaccatagctcactgcagcctccacctcccgggctcaagcgatcctcctgcctcaacctcctcagtagctgggaccacaggcgcatgccaccatgcccggctaacttaaaaaacatgtttttggtagagatggcggtctcactgtgttgtgcaggctggtctcgaactcatggcctcaagcaatccttctgccttagcctcccacagtgctgggattacaagcaaaggctctgaggcagaagtgtgcctggtgtgttccagaaagggctaggggccctgtgtggctgcatcagcgtgagcaagggcaagtgtgggaggtgagaaggccagagaggaaaggctcgatcatgtcgggactgtaggctgccatcagggctctggctttcactgtgagtgagggaagcccactggacagcttagagcagaggactggggccacctgacttgggtttaaaagccgccagctctagccatccagccatggggctagggtggccggctgcacctgggccatgtttgggcagaggtggcgggacggggtcacgggacaatgaaactaaagactcaagctctgggtgaatgaagcccgcacttgtggaccaggttggggagccctatctggaaagagctggtccctgtgcccgttctcctcctccctttcctcctgggactcccttgcaggctcactcctccctatttggattcttatgcacagaagactcattcgctgctttttctaccatcgcagcttttgagggcttttcagcaaggactcaatccctgtcttagtctgtttgcattgctatagaggaatacctgatgctgagaaattcataaagagttttatttggctcatagttctgcagctgtaagatgggtggtgccagcatctgcttctggtgagggcctcagaccacatctacttctggcaggaactggcggaaagctggcatcacatagtgagagaggaaggatgagtcattccacctggaatctggggtgaagtcaactccagcagaatcaaaactgctgaagggaaagggagggagtggttctaggggaaatatgcacactggtacaggggaacagaggttgggtgacaaaaccaacaggtgccctctgctgtggcacagacatttcaacacactcaaaatccacttccaatgttttgaaagaacaggactaggagagatggtttcttattcgagcagactcttcttttataaagtaaaggcgtgtatttccaaagtaatacatgcttgatgaaaatatttcaacatggaagtctgagatttaaaaggtgaaggttttatttccctaaagctattgtccagcgatgagcactcttgagcgtggaggtggctttccagggagttactgtgcacatccctacatgctcacgtggcgggagcacactgccaaaacaagagtgtgccatagcctatatgcagagatctggtgacttgttttaacctctttctatgctagtacccaactatctaccatgctctctctctagcttcctcacactttttcccctggggcagttgtgcagtgatttatttaatttttctgcggctgatgaacatttacattctaaaaactatttacgtggtggtgtcattaagatgctggtggattctacctaacttgcaaatccaggagtttctcagatggattcctcaaggtgggtggaagggtatgcaccctagaggaaaagagaaagttagccccagacaagcagaaggaggacctaataaatcacaaagca

SEQ ID NO: 1949 - DNA, 1600 bp, artificial
  synthetic oligo
tgccactgcactccagcctgggcgacagagtgagactccgtctcaaaaacaaaaaaattttttttatttttgtagagacagggtcttgctctgtggcccaggctggtctcaaactctcgaccccaagcgatcttcttgcctcggtaggtacacacgcaaaaacagatggccgcagccttccacacggctgactctgcaaacagcgagattctccctctcccacagggcagtgcgctcgcggatactcctttctctccatctcagggactcacctctctgggtgtctgcatgggagcctcgcccattccccctcctcaccaacctggccactccggcgcccgtgtgggtgtaaattgggggcatctttcaagacagggcagaaggagaacctgctctctgtctgctctccacctcagggagccctcctgccctcttgcgtttcctcctgggcccttgaggccacttgagggaagagaggggaagcctaacacactggagacacagcttcaggaaggaagacacagagctgagccaaacaaaggaggccgctctgggaagctcagggaatgaggccccagaggacagatgagcatcatgggcagagcggggtcagattccccgtgaattcaatacctcagccaagcagggtttacatcctagggcaggaggggaagaggcagctccaattaaggaagggccgccctctggagacaggccccgggtcactccgggggtctccctgcagcgcctgtggtgttgctcccagactcagtgggccagcaggtccctacctgacagttactgtgctcctggatcttcatctttgctccctgggcttctgcttttgtgcccgtgatgttggctgcaggggccagtggctcagcacctggtcaaagttgtttggatgcagttacagctgcaatgcagctggacttctgagtcagcccggccagggtcgcggccctggggcatggtgacctctcccggtgctgcttcccctggggcacggtgaccttgctggggcgggcacatgctggactcgtggccaggtttgcccgggcctccccgtttcaccaggagtcaaactcctctaaccgcgtgtgacgaccactctgcatgtttgagaggacggaagttaagtggactcttcagacttgacttggaattctggaatatgagggctagagggaagcattagggacctcttcacctgaggctggggtgtgttctgccacagccctgacccatgctcccaccagctgtgacagagccctcaagggctggagcgctcactggctcccaaggaatcccgctggcatgacaggaaggtctctctgacattgctgctggtctttcagttttcctttgcgcacctcgggctgaaacagagcgagttcactgcgtccctgcattccaggaagctccccaggtctcagcgtcctctctcagcttccatccgtccctggccttgacagagagccgggcctctcctaacacaccaccgatccagaggagaaggaagccgctcacaccctccggggcaggcatgcggaggtggcattcgcctggcttcctgctgggacttcctcacagcgtgccc

SEQ ID NO: 1950 - DNA, 1850 bp, artificial
  synthetic oligo
aaatatcaaagaactgaaactcaccagataaccacatccagacaatgagatgctggaccccccaaattcatcaggattgctttctgggccctcccgagttcctgttttcctacacattggtgcatttcttcctggctatataaacccctagttttagtcagggggatggatttgagacttaactcccatctccccggctgcagcacccaattaaagccgtcttccctggtaatgctcttcgtctcagtcagtcattggctttctgtgcggccagcagcaggacgtagaccaaacccttggtatttcggtaacaggcacacccccaggaagggaccccggacacggctaccacctctaggcttaaagcgaatgcacttcccgcatctccagtcttccgtgtagcagctttaacctatgtatgtctgtgccacatccagtcctcagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttctgcctctgctgctctaagaaggggtcagggtgcaggaggcagggggaacctcctccagctggagctgctgcggtgagcaaggctctgctctggaggcctctgaggctggcacccttctggggactgggaagggggcagggaaggcagcagcccagggaaagcctcgtccccccggagccgaggcagttggggagagcaggacgagagtgagctggagagcagccacaccgatgggtaagggtgggtgaagggattccacaggtgtctagaaaactggaaagagctccttagcaggtccaggccccaggtgtaggggaggaccagatgtggaggatgaagacggttgtccagagggatctccaggcgttggcattattgggtcctactgagatgctgtcaaggagaaaacacaggctgtgtgtggcagggcgacaaatgagtgctgctgccaagctctgtcctgttttctgtgcacgtctcagagcccctccagtgaccgtcatctccggcctcctcctgcgcctctgtgttcgtagacatcttctcacatctcagatcctgctgagcctctgggccccctgcacgtgccttctgcctctcggctgctggggtggggacctctgtgccctgtgccagcgcctctcctgcagctcacaacacatctgctttttctcctgcgccctgcacagggtgggcctggaagctctggggaagttgtacccttggacacagccccccaccgatggggccaagagtcactggataaaagtcttagtctctcaccctttgaaggacaactctgaggtgcggctgactgtggagcgaatgaaatgaaacggatgcacggggatgggtgtggacaaaggaatgccgacttctcaggctgccgatacatatctcagtagaagcacgggggaatgctatatagagaaatatttctatagtatctgaagtgtttagaatgtattgacctaatatatacacaataaaagtaaaaacattggaagaaaatttagatgaactttatttgattgttggaatggaaaagacttttctctctttctttctttctttctctccttttctttctttctttcttttctttcctttttttcattattataccttaagtgctggggtacatgtgcacaacgtgcaggtttgttacataggtatacatgtgccatgctggtttgctgcacccatcaacttgttgacctagcaatcccattactgggtata

SEQ ID NO: 1951 - DNA, 1150 bp, artificial
  synthetic oligo
gcatcatctctcacctatatgatgagaacaatctcccccggtctacacagattcccggcccctttcctaggaatttggcctgagtggggcggtctaagtggggatgatgtaggctggcctcatatggcccagggggagggcccagccatacctaccagggctgatgagcacggcttgtttcgccctgtgggggtcattgcaggctcttgtgcgggactcgggatgggggtctgttgggaagccccggatggcctagtgtcctggccttgagcctttggtcttctctgagcgcccacccgccatcacttgagaacagtgaaaggcagctgtgttgaccctttgagcagcatgtggccgttcctaggtttggtggtaggggtgagtgaccctttcctgtgaaggaatggcgagtaaccattgtatgacagtgaattgtcttagtgcctaatagcccagcctactttgtgagctccataaaggcaggaagcttgtctggagcttttctgtatccccagtgccaaaccccataatggggagacacgaggtactctctcattctttctttcaagaaatatttcctggccggtgcggtggctcatgcctgtcatcccagcatgctggggaagatggggtttagcatgtgagtgaggaccacacatagcacagagagcacccagtcgcccaagccagagtatgcagagttgggaaggatgtagcaggggactgaagtgacgtagaaaagaccgatcatagcgagatgggcaacacaggtagaaaaggcttttcttcagccctgggtggaatgaatcctgaacagcagccacaacgtgtccataggagaccacgaccaggacgcagtgtgcaagagccaccagaaaactgaagaacagggcaagttcattggtacgtgtgctgaagcaagagagtctgagcagtgacggaggtcgcagaagaagtgggtgatgaggcaaggcctgcagaacttgggtagagctgtgaggatgctgtaggtgaatgcgttggccaaggccagcaggcaggagatggaagtgaggcccgtgtgggtcagtcggcccacgaggacaaagtagtgcaatggctggcagatagctgcatagaatcataggccacggctgtgaggaggaaggac

SEQ ID NO: 1952 - DNA, 1400 bp, artificial
  synthetic oligo
atccgccacgccaaacgggctggtccctgggtctcagggaccctggagctgaaacccaagtaccacctgcatctgccatgtgcatagttcacggagaaacaaaagcaagactcctcttggacttccctattccacttgattgcttgcacagtagtgtgttttctatgtccctcccccaaagatcgttgtattcagtgataagctttgccggctaaacggtctaaatgtcttaatgaacccaaatgacccaaactcaaaaggtagtgctgtttgcaatctctttgactcgaaggttttaaaagatggatctaaagtcgattgtgccaactagtgtgctgaccacgctaagtaaaaataacaatcatgagcacctaacacttgtgaccttccttactgccaagctaacaccatgccagcgattgtgctaagcactttccaggcgttatctcattgaatccacacaacaccctgtcaaagggctcttattattatctcaattttgcaggttactaaaatgaaaaacaggatgacagtgtcacttgtcgagagccacacgagaaaatcatccataggcagccagagctgtgtcaagagcccatccacttaagcaccaccctctgctttttgtgggtatcatctatgtgacgtttgctagcatcttcaacagaatgaccaacctcccatcctatcaggccagatgcttcagggtgatgagctaacatggtaacaccagtggagtccatcagcatgcgcacactggcttataatgattttcttgtgtgagataatgtcagtgtgaataatgggttcagtaagtcaatgggcaggagtgccagcagaaatgtgaattttaaaaaagcgaatccatgtacaaaattagtacctgttcaagtgagaaaaaattgctgccccttccagatggcagtccaggtggctgtctggtccccccagggaatgctgttattaagggttcattgtttgtctctgcctgtgggcagcttgagcacttagcagtggctgtggccatatcaactgttgccagtccctgagagccccactatgcattgctaattctctaagtcttgcttacacctctgttaaaaaaaaaatcccttaattatactttcctcatttcaaccccttgagtctactgtttgcttccttttgaaaccttgaccgatagacctggtcatgaggaactccctacgacattctgggtgtaagtccagggaatggtgatcatgcagcagcaggggccacaaagatgtgagccacctgctctagcaactttcctgtaccttccagacctgcttgagtctggtctcaaatattccacttccaaaagaggatgaaatagcaccaaatttatcagtggcagctgaagttccatggttctttgg

SEQ ID NO: 1953 - DNA, 1200 bp, artificial
  synthetic oligo
acaatttctgagaattctctatagaccctagtcaaactttaccattactgctcataggaaagtatagcttcctgctgcactgaaaagaattgactcaaggaagaaatactgaaggtagggaggatatttaaggaggcagtgtcattgcccaggtaagaaatgatggtgacctgagttaagatggccacagtgggaagtggagaggaggagatgtatttgagaggcacttatggaatagaactaatagaagcatggagatggattcattatctgagattctccaccagattattaaaaaaagatataatcagcccaggttcttggagcaaaaataatagtatttaccatattgtcctgaagctgtaatctgaaaatctctaatgtgtccagaagccattcccaggggagtctgacactctgaaatgaaacgggtggaacacagtaactagaagtgcacaaaattcagcttctcaaatgtaagtcaatgaaaatgggagaacgtcaacaaatgctattttttagtgtttaaatgtgccaagaactgtactcaacgttttactgtattagttcatttaattaatcctaacaggtgctagaatgattcacattttacagctgaagaaactggggtccgtacataaatagaccagtggctctcttacttgtttagggttaaatctccaaactcttccaagtagtatttctaagttatctggtaactaaatcaacattaaattccaaaatctgctactggagatcttcgagctttaccaagttgtgaaaatgaggtggtattttttttttgtcaattatttagagcttcaggtacaaagtgttcaaagcttcaagtatatctgccctactctgagaactctgatgatttctaccagcaatattcattttaaatttgataatgatgtaaacttgtatttatttcctgacacaagcaaccattccagaaaggaagaaagctgtaaagaagtaggctgagtaggtagggaacctctgcccacattgctactcactattgctgtacaccagaaaaagtgtgctcatcccagcatgtagatgctcgccaataaggcattccacccgccaaattccagctttggatggtaacatttccactgtctcaaaaacaccttataaaaaccaacaggaacagaaattatttcttttcactaaaaaatgagcatgaga

SEQ ID NO: 1954 - DNA, 1600 bp, artificial
  synthetic oligo
ccaccgaaactggcaaactgaagtattgtagaggctagagtgacaagatcagatactcacttcagtaagcttcctttgagagttatgagacagatcatgagggcctcaattaagaagatggcaatgtaaattgataagggggcaagaagaatattatgttactatgattacatagtgattacattaggaggaggaggaagaggcggaggtactaacactattgagggcctactctatgccacacagtgctctaggttacttaagtgaaatcactcagcactcacaacaatcttatgaaaaatgtactattatttccatttaggaaaccgagacacagagaggttaaataacttgccaaaggttgtgcacttaataatagatgaagataagagaaagtatttagaaagtagagcccaaagtatttgttgacagtcttaatgagggggatgaggccagtccgttatccagctcctctatcttcttacctcatagctgccagtggaactgaggttacgttttgttttcttggaattcatttttaaccccatctccttcattcctgaacagtaatgtaatttatgatctttctataatcacctcctcttaatagtagcagaggatttctttcaggaatccaaaattcagattaagactcactaaccttcatcaaatacagcaaaaagtagtataaatttgtgcaaggtctgtgtcttttccttggccagactccctgaaaaagaagtgagaacatttatcttctatttaaaaaatctcattgtaggaaattgtcactaggaggagacagttcttcatcagttacttgacagtaagaacaaatgtagtcttctgtctcttgataacttggctttgatgtcaggtctcctatagcagtgtttctaaaactatctggagcaaagaatttttttatttcaactttgatgaagaccactacttgtgtaaaatatgataaaaatgaattactaaagaaaaaaattaaaaacacttacaaaatacaagccctcacacactgtgtgataatagtgaaattatagataatttctgttactcttgtaactttttatacttctgcaattgtaaattaaaagttttgagtaaaatagcaattgtccatattaaacatctatactcatgattttttttcaatagcccacagtgcttctaattatactcacattttaaataaataccgtgtatatcgatagctgaagtttttaatggaacaaactagcttgtttcatgctttaactgttgagcttgttggctatctttcttagaattatatattttttaaatttgactggaaacttttgtttacaggcttattttgagtagaaagatttttgtttatgacattttgccgttctttctctctctcgcacccttaatgcttagaaataaaaattagcttggactaagaaagcaacagtacgtgtgctgctactcatcaggctgggataagagacatagataaagctaactgcagagttaacaacaccatttctcccaaggacacattgccactgtataaactcactgaatgccaactatttgctttgattatctcttgctttcttactca

SEQ ID NO: 1955 - DNA, 1700 bp, artificial
  synthetic oligo
gtcaaatactatatctcttagagggatttattccaaattaaaattagtgataatttggagaaatatttcctaaagtttgaagtaagtccttgattggttctaacaatgattaatatagatagggatcagtgaagttgaacaaaatttgcatgtgtatctgatatctcaatgtttttctgtagaaacgttacctacttttcaaaaacaaaatttttttttggaaggcactgaggtgggggagagtggtgaagaatagaattcccatatacttttctctccaggaacagagacattatcttacaaaactgctgaccagaaaaggtcagagtcatggttagctaacatgtcttcatcctcccaagccaaatcgcatagaagccactggagaactagtttggaattccggcttcactactatgtagttgtaggattttggaggagctgtacaggttcactgagctttagtttcctcattcacaatatgacgataccaatttcttcctcatattatatctaaagacatatctatgtctatatgcttgatcgtacattatgtgcggagataaaccggtaacagtgattgcctctgagaagagagacttactttccattgcgtaattcttaggctcatggtagaatttgtgcaagtggatgaagcactgcctcactgggaaacactccagtgaaataaagcacagaaaagagcccgaagaataattacttggttctgtatgacacatgtgcttttaaagggttgtagtgtaggatgacattgggtaagtccatgggcctagaagcctaggtggagttcttaggattttgtatgtagactatgaagttttggaaacgtttgagctggagagaagacattctgatcaaaggtggctttcaggaaaggctggtgcgacaggcagggtatttattagaatgaggccagtgaccactctgaaacagacacaaagtaagttcccttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacct

SEQ ID NO: 1956 - DNA, 1100 bp, artificial
  synthetic oligo
aactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaac

SEQ ID NO: 1957 - DNA, 1850 bp, artificial
  synthetic oligo
gatggggacgaggtcacctccacatgtgggtggggacaaagtcatccctggatgttgactgggacaaggttatccctggatgtcgatgggttcaaggttatccctggatgttggtggggaccaggtcatcctgtgggtgggtgaggactgccacatcccgttttcctggtaaagacatcttttttctagcaggatgggccactggagcaggcataactctcagttcccagctggtggacagccaagtccccagttatctggtgtctgtccttggggccatgttctttcttctcatttccacctgaggaaagaaaggccaaggtacaaggccttcgaccaggtgtcactggggtttctgggctggaagtgcttcgggttgggagagaagtctcccatcttccacaaagtcaacaggtgtacatcaaggcttcgttcataatcctcggtgggaactaggagagagattggatgctgtttaaagggtgatgtccttgggccggcgtttgaggaggtgtgtgccctggtcagctgtatttggggacattaattttcagcctacagctgttcgccaaacggggtctgtacgcatcaggatccagccacgtccaaggctcccaacgagctaggtgcacctcctccaggctccactcacatccaggagggtcacgggcctgcctgaggtctgcctgctcctggcactcagcagggcactcaccagggctgggaaggcccctgcccatcccggtcctctcattgcagtgaaccggaggctcctgtaccggctgcatccggagcagggcatgccggccggcgtgtgcgtggacgctgcggggaagctctgggtggcctctgcgtcgatagaggcaaggtgatacgccttgaccccgagacaggtgtgtgccggatggcggggccgtatgaggcttggccacatcgggtgtccactgcgtctgcagcgttctggcttcagaagtcggggccgggcagcaatcgcgaatttgtagagactaaggggcctccgtttcccgacggcacggactcccaggttccctctgcaggtgtgctaggtcctggggctgccgcaaccaaggactggctgcctaagaaacaggaagtcacctcccccagtcctgcagagcaggagtctgagaccgaggagtttcagggccgtactccctccaggagctgtagtggagggtccttcctgcctctcccggctcctgggggctccaggcgtccctgggcttgtggccgcatcactccagtctctgcctccgtctccacgaggcctcatccactgtgtctgtgtctcctcttctgtctctagaaggacacctgtcattgcatttaggatccaccctactccaggatgatctcatctcaagatccttcactaactagatcttgaaacaccctatttctatacaaggtctcattcctaggttgtggatattagggtgtagacagatctttttgggaaccacagttcaatccacttcaattgtattgagactctaggggagggtccttcctgcctctcccagctcctgggggctccaggcatccctgggcttgaggccgcatcactccagtctctgcctccgtctccacgtggcctcctcctctgtgtctgtgtctgctcttctgtctcttagaaggacactggtgattggatgtaggacccaccctaacctgctctgacctactaattacctctgcaaacaccctatttccaaataatttcccattctgagatcctacttggcatgaatctggggagactacagagctcactagagcaggtgcggctgggcctggctaggcaggtgccaatctggcagctccaggtg

SEQ ID NO: 1958 - DNA, 1750 bp, artificial
  synthetic oligo
caccgtaggtgggagatcaagttggcaacaatagtgttccaaggtaatacaccctgtatctcagagaaattgaaatataaccatctcagaggttttttgtttctttggttttttgagactgtctcaaagaaaaaaattgaaaccctgctccagggctaggaacccacaaatttgagcacagctgtcactgtcggtatcaaacttgtctttattttttcagctgaggtcttgctctgttgcccaggctggagtgcagtgttgggatctcagctccttgcagcctcaaccctctgggctccaccaatcctcctgcatcagcctcccgagtagctgggactacaggtgtgcgccaccatgcctggccaattttaaatttgttttttgagagatgggggtcttgcaatattgtccaggctggtttcaaactcctggcctcaagcgatgctctcatatcggcctcctgagtggttgggactacgagcgtgagccaccatgctcggctgattttatttttaaattgtttgtagaggccaggtgcagtgggtcttgcctgtaatcccagcactttgggaggccgaggccggtggattgcttgagcccaggagttcaagaccagccttgccagtatggcaaaacctcatctctactaaaaaaaaaaatacaaaaaaaaaaattagccaggtgtgatggtgtgtgcctgttatcccagctactcgggagagtaaggcaggagaattgcttgaacctgggaggcggacgttgcagtgagctgagatcgtgggtgacagcgaaagtctgtctcaaaaagaaaaaaaaaaatcaatggtttgtgaaaatacagccggtgaccatggacccccctaggcacagcctcaagccacccagaagaagatggaaaaggattttcttttaaatcagcgagatttaaataagcatggcgagcacagctgggaggccccgccaggaattccgaaggttgaaaggggccctgtccgctcccccatcctggaaatagtgtccatggagctgcggagtccgggtgggcgccggggacgagctttcaacagctcacccggccccaacattccgtccacacattccacggccaagacagtcaccccctgccagggattaaccgagggccacgcttagtggcaggaatgcacgcgcccgatttagacatcccgcttggcatcggcggtcagggtggcttgcaaaggcccggggtgggtggatgccggagacgctggagctctgaggtctacaggaggaattgcttttccgatgggctggtcagggaggaaggaagctggggagaagccgggagtcccagcctccacaatgcctgcccttccaagacgagccaggccccccggacaggatggcagcccccctccaggccagcatgacttcaggcctggggaatgtgccaccttccgaattagaagggcactggttcccacccgcggggaaccgtaacacagcgtctccctccttcctccaggacccacggctgagctcggagctgcccgagagctcgggatgtggggtgcagagcagaggagaaacctcccccgaccccgggtccttggggcatagggtctttttcagggccatctgcggaaagaggacctgcgtctttaccacccgggggcccttgtctttgctgctcagctgtgtttaggtccccgttgctgggtgatactggggagacgtaaacagacctcggtcagccggggctggggcagga

SEQ ID NO: 1959 - DNA, 1000 bp, artificial
  synthetic oligo
ccgtgtgagccatttttcgtttgtttgtttttgagacggagtctcgctctgtcacccaggctggagtgcagtggtgtgatctcggatcactgcaacctccgcctcctggttcaagcgattctcctgcctcagcctcttgaggagctgggactgcagacatacaccatcacacctggccaatatttaattttttttgtagagacagggtcttgctctgtggcccaggctggagtgcactggtgcaatctccgctcactgcagcctccacctcctgggctcaggtgatcctcccacctcagcctcctgaggagctgggactacagacatacaccatcacacctggccaatatttaattttgttgtagggacaggctcttgctctgtggcccaggctggagtgcagtggtgcaatctcagctcactgcagcgtccacctcctgggctcaggtgatcctcctgcctcagcttcctgaggagctgggactacagacaggtgccaccactcccagctaatttttaaatttttttgtagggacagactcttgctctgttgcccatggtgatcttgaacacctgggcttgatgtatctgcccgcccaaatcccgcctttcatttacactgcccccacccctgcccaccccagggaaggtctttattcttaaatctgcctttctgacctctcttcccaaatgtgtgtatttctaacagatctccgagtccagatcacgcacaccgttttccataatccagggatttggagccgccggaggggtgaggaggggaggcggccgtgactgctaggtggaggtgggctctcgtaaacgtcgttttacgggcaggtggaaacctttataagcccacaaatacttcaagcctgttcctgcccctggggccctggagacttctcagaggacctaacgggacctggcgaaaggccttcatcaccagcccactaggaactgttcaccgtgtgcccggggctgcgtctggcacggaggt

SEQ ID NO: 1960 - DNA, 4500 bp, artificial
  synthetic oligo
cctttttttttttttttctgagatggagtctcactctgtccccaggctggagtgcagtggtgccatctctgctcaccgcaacctccacctcccgggttcaagtgattctcccgcctcagcctcctgagcagctgcgattacaggcacccgccaccacgcccggctaatttttgtgtttttagtagagacggggtttcaccgtgttggccaggctggtctcgaactcctgacctcgtgatccgcccgcctcggcctcccagagcgctgggattccaggcgtgagccgcattcgttcccttgaccgtaaacgtctgcaggcgaggaatcagccgtcagtcaagagggagtcactgcggttcattcgcctctgacaacgggtcctcccggacgccgcgtggcttgttctgaagccgggccggagacaccgtctggaccccacgctgctccccagggccgcctccaagaggatgccccaccgcagggagccgtgcaaacaccataaatcctgctaattgccaccttcccggcagccagcatccgtggtctctctatagtggcctcacggtctccagccaggagctcgatctttgcttctgcacaaacattaccgagaaacgtctgcaaaccccgggcgcccggctcccacatcacaggcgctgcgcctcagaacacaacttgtttctgccgatccaccccccaccgccgcctccccgggcacctcgccacgcaggacgctccgggcttcccgtaagaacacccgtgtctgtgacctgcgggtggggtcacctccccggcctgcatgccaggtgaggcggggggggctcacctggggctctcacctgcccgagggggtcctgcccacggctctgcgacagaatagaatgatcagggcgatgcgtggcagtgccctctccctgccccagcccgagggcacctgttcccctcctatctcagccactctgcccacgtctgtccccacaaaacgcggtcggtgcagccctggggcccggtcaccgtaccgcatcctcctgacaaagacagaaagaaaccggctctttgattctaacattaaaaaaaaaagggctgccttctgcttgcaaaagaaatgcacgcaggctgctggcagaaagttctggaagatgataaaggaaaaaaataaattaattcgagaaaactttgagacgcctaacagcacaaataccctcagtctttagagaacagctggggatacacatattctggctcatttccccatggaacttttatttttattttttgagatgagtctctctgtgtcgccgaggctggagtgcaatggtgcgatctcagctcactgcaacctccgcctcccgggttcaagcgatcctcctgcctcagcctcccaatagctgagacgacaggcgcctgccaccacgcccggctaatttttgtatatttactagagacggggtttcaccgtgttggccaggctggtctcaagctcctgaccccaggtgatccgcccgcctcggcctcccagagtgctgggattatgggtgggagccaccgcgcccggcccctcttccttccttcccttccttccttcccttccttccttcccttccttccttcccttccttccttcccttccttccttcccttccttccttccttccctcccttccctccctcccttacctcccttccctccctcctttcctttccttcccttcctttccttccttccttctttctttttccttttctttttgagatgtagtctcactctgtggcccaggctggagtgcagtggtgtgatctcggctcactgcaacctccgcctcccaggttcaagcgattctcctgcctcagcctcctgagtagctgggacgacagacgcccgccaccatgcccggctaatttttgtgtttttttaggtagacatgaggtttcaccacatcggccaggccggtctcaagctcctgacctccagtgatccgcccgcctccgcctcccaaagtgctgggatgacaggcgtgagccaccgcgcttgtcctgctctgtaaattttgttttgggccaggcgtggtggctcacacctgcagtcccagcactacgggaggccgaggcacgagggtcgctggaggccacgagtttgagtcccccagcctgggtaacgtaacgagaccgtgtctttaaaaatcataaaagacagatcagctgggcgtagtgacacgggtgcctgtcgccccggctcctgaagaggctgaggtgggaggatcgctttagcccaggagttggaggctgtagcgagctgtgatctcaccaccgcactccagcctgggcgacagagcaagatcttgtctcgaaaacaaaacaaaacaaaacacaaaaatttaaaaaacagattgagaacccttggcccccacctcttaccagctcggtcacaattgcaaaccagaggccgggcacggtggctcacgcctgtcatcccagcgcttcgggaggccgaggcgggtggatcatgaggtcaggagctcgagaacatcctggccaacatggagaaaccccatctctactgaaaatacaaacttagccgggcgtggtggctcacgcctgtcatccgagcactttgggaggccgaggcgggcggatcacgaggtcaggagctcaaaagcagcctgaccaacatggagaaagcctgtctctactaaaaataccaacttagccgggcatggtggtgcacgcctgtcatcccagcgcttcgggaggccgaggcgggcggatcatgaggtagggagctcgagaccagcctgaccaacatggagaaaccctgtctctactaaaaatacaaaattagccgggcgtggtggtggcaggtgcctgcaatcccagttactcaggagaggctgaggcaggagaatcgcttgaacccgggaggcggaggttgcagtgagccgagatcgcacccctgcactccaggctgggcaacagagcaaaaactctgtctcaaaaataatataataataataataataataataataataataaaaacaactgttttcatgctgcagacagcacacaggccaggacgtcagggtctcgtgaggggccgtcggagaacgtctaagggacgtccctgcattcctggctggaggtcctgcgccagcgccctccttgtgagaacactttcgctctgcaaactctcagagcccccacctgctcccgcctcccgtctgtcctggttcttgggaccccggagccttctctgtccagacctcccaggtcctgacgggaatccggataaactccttggggcgaaggtgttaacggcagggcccctgtctaatgtatttcgccacccagataaaatgagtgttttcacagctgccgttaatttcttaccctgaggaagaaaggaaggactttgaggcacctgcggccgggttggggtggggcagggggatttctggacgcggacggcgtgtggggagttcctggggtccccagagccacaccacgtaggtggcagccggctccgtcctgcaaagccccggcttcggtgaaagatttatcacctgctcggcctcggagacggggaagaaaaacacagcctggaagtggtcctggctgatggacgggcccctggggagctgtccccaaatgcgcgtcttctttctcctttctgtcacagcctcccggccctgccctggctgagtggggctttcagtgaacgcttgttgagtgtccacggagctgtgagtgctgttccgggtgctgggtacgtggtggggtgtgtgaggttccctcctctctagtgcagagatcaggagtgagtagacaaagaaaatagcatctaactgctgcttgtgatgagttttttttttttttttttttgagacagagtcttgctcttgttacccaggctggagagcaatggcgtgatcttggctcacggcaacctctgcttccgggttcaaggcatcctcctgcctcagtctcccgagtagctgggagtacaggcacctgccaccacgcctgggtaattttgtatttttagtagagacggggtttcaccatgttggtcagcctggtctggaactcctgacctcaggtgatccatccatctcggcctcttaaagtgctgggattacaggcgtgagccgccatgtctggcctttttcttttttttttttttttttttgagatggtcttgctctcattgcccaggctggagtgcaatggtgcaatcttggctcactgcaacttctgcttccgggttcaaggcatcctcctgcctcagcctcccgagtagctgggattacacgtgtgcaccaccatgcccggctaattttgtatttttagtagagactgggtttcactatcttagttaggctggtctcgaactcccaacctcatgatctgcccgcctcagcctcccaaagtgctgggatgacaggcatgagccaccgcacctggcctatttttttttttttttttgagacagagtcttgctct

SEQ ID NO: 1961 - DNA, 5550 bp, artificial
  synthetic oligo
gtaatcccagctagtcgagaggctgaggcaggagaatcgcttgaacccgggaggcagaggttgcagtgagctgagatggcaccactgcactccagcctgggtgagagaaagaaactgtctaaaataaacagggaaaacacctctggggcttatgtctttcccgcctgcatccgatgaaccttaggtgaccgctggggacggtactgagggttccaggcagaggaaagccacatctgcatgcagagaaaactccagtggggacagagggggtgcatcgtgtttagaagccacgtggggggtgggggggcaggtgtgtctcatcgcacacgtgtgaacggagtgccgggggcccctcttctcctgagcccccaaaggcacgagccggtgggtctcgggagttgtggggcgattcctggaggtggctctgtgcaaagtgttgtcatatcagccaggaaaacacccccttgccacagcctcaagtcaacccaatctcgtctgaaaggtttggatggaggtgggggggtccctggcttccgtcgctggagcggtggccgcagggctggtcttcactgtcatcgtgatgtcaccatcgtcctcacgttgggtgtctccctggattctcggctctccagggaggcggcgacggcccatcccaccagctgcccacggaggcggggtccccgggatgcaggcttgacctcagaggaaaacccacctgagccattctagggggaggggacaccaggaccccccaaaggcctggtcggctgaggtcatggttcatcccggggttgggggaggggacaccaggaccccccaaaggcctggtcggctgaggtcatggttcatcccggggttgggggaggggacaccaggaccccccaaaggcctggtcggctgaggtcatggtttatcccggggttgggggaggggacaccaggaccccccaaaggcccggtcagctgaggtcatggttcatcccggggttggagcagaacgggccgtggaggatgggctcagggagtgtttgttcatggcgtgaattcacacggaatcttcctgcctccctccttccttccttctttcctccctccctccgtcctttcgttccctccttccttccaatttcctccctctctccctccctgcctttctttgtggacagcctggcatctgcaccgtgtcctggctgagcctcctgccagctctgcggcctcgttgaggggggcggggtgcgtgtctcaccatctttgcacctcagcttccccatctgtgacgcagggacggcaacaggcacccctcgaggtcacccctccagcatttgtttacagctgtctcacatgaacttagatccatggaagagcgtcaccctgactcgtcaacctgcaaaaacggcccaggacagagaggggggcccttgggatggtggcggccgggacccgaggctgttgtccggtcgtagagccttagaggctgttggcggtgtagacgcgggtcccaggctgcaagctgcctctctcctctgcctcaggctcttcttttctatttatttatttttaagacagggtctcgctctgtcacccaggctggagtgcagtggtgccatctcggctcacagcagcctccaactcctgggctcaagccgtcctcccgcctcagcctcccgagcagcggagaccacaggcatgtgccgggctaattttctaatgttttgtagagatgacgtctttgctacgttgcccaggctggtgttgaactcctgggctcaaggcctcctctcgctctggtctcccaaagtgctgggattagaggtgtgagccaccgcgtctggccaagacgtcttttgggggggacataattctcaaccaaattgcctctgtctctccttctcactctctctctctccacacacacacacacacacacacacacacacacagcttgtatgtatatacgcatttatacaggtgtggaggtgtttgtgcatatatagatatatatgatatatacgtatatttaagccattagaacatgatttccattgctaatatttcagtgaatatctcttttctagctctaactccacacacacacacagacacacagacacatcccttgtatgtatatatgcatttatacaggtgtggaggtatttgtgcatatagagatatatatgatctagatgtatatttaacccattagaaaatgattttcatgctgatagtacttcagtgaatatctcttaaaaatattgatcgcacacgtccctcatgaaaagcaatggttccctaaacacagactgtctggtccatctcggagtttccacagtcgtgactcacatgcaagcaatgtacaactatggcagggctgggctccttccctcccagacaggctcaaggttatgctccctgtgccgggatcagaatctggaatcaggacggccactccagtgacatgaaaggcacacgggtgacaggacggacaccccagagacaggacggacgccccagagacaggacggacgccccagagacagcacggagaccccagagacagcacggacacccccagagacaggacggacaccccagagacaggactgatgccccagagacaggacggacgcccccagagacagcacggagaccccagagacaggacggacgccccagagacaggactgatgccccagagacaggacggacgcccccagagacagcacagagaccccagagacaggacggacgccccagagacaggacggagaccccagagacagcacggatgccccagagacaggacggaggccccagagacagcacggacgccccagagacaggacggacgccccagagacaggacggacaccccagagacagcacggacgccccagagacaggacggacgccccagagacaggatggaggccccagagacagcacggacgccccagagacaggacggacgccccagagacagcacggacgccccagagacaggacggacgccccagagacaggacgggcgccccagagacaggacggacgccccagagacaggacggacaccccagagacagcacggacgccccagagacaggacggccgccccggccccgcgttttccatgacatattttctcttcggccacaggatggcagtgccagctacggaaacggtggaccgttgtcggaccctttgctgagttttgaaacacgtcactgccttcagccttgtgggtccccgggctgcgaaccccgggaccgccttcccgcctcgtgggccggggctcaggtctttacattcatcccaaaccgggttcaagccccatccctcccccggctgccaaccccgtgccgttcaggccccgtaaccggctacttcggaactgacgtcgtgaaacctttgctcgactgtgtttctgacgctcccgtcacagaacagaagctgtcgggagtgagcaatggtctagcccaggagaggaaaatcagccgcgtttcactttgcaccgtcatctcctcagccgccccgttccctcccacacttgcaagattccgagggaggaagccgcttctcggacccgggtcccaagctgtgcagaaaaggccaaggacacatttccgtgtctgtagacgcagcaggcggccgccagggcctcttgggcaaaagactcccattcccggctttgcctgcagacacccctcctcacacgggctctggaggtctgttggggttttcctcaaaaagtttattttttttgtggtttgcttttctagacagggtctcattctgtcatccgggggctggagcacggcgggaatgatctcggctcagagcagcctccggctactgtggcctcaagtgatcctcccgcctcagcctcccgagtagccgggaccagaggcacctgccaccacgcccaactcatttttttgtatttttttgtattttttgtagagacggggtttctccatgttgcctgggctggtcttgaactcctgggatcaagccgtccagcacctcagcctcccaacgtgccgggatgacgggtgtgagccaccgcaccgggcctattttattttattatttcttttgtagaaattgtttaagtggctacaaaagtccacaaacatcctccctgagattctcccttagaataatcgtcttcgtgggcacacagcatgtgctgctgctgacctgagtggcctcggctcgacgtctagacggctcagcgtttggacagtttccaatcagggtctgtcacccaggctggagtctgggtgtgatctcggctcactgcagcctgtttcctccctcccttcctttcctccctccttcctttcctccgtccctcctttcctccctccttcctttcctccctccctgcctctcttccttcctttcttcctggacagcctggcatctgcaccgtgtcctggctgagcctcctgccagctctgtggcctcgttgaggggggcgtgtctcaccatctttgcaccccagtttccccatctgtgaggcagggacggaaacaggcacccctcgaggtcacccctccagcatttgtttacagctgtctcacatgaacttagatccatggaaaagcgtcaccctgactcgtcgagctgcaaaaacggcccaggacagagaggggggcccttgggatggtggcggccgggacccgaggctgttgtccagtcatagaacctcagagcctgttcaaatcagggtctcgctctgtcacccaggctggagtctgggtgtgatgtcggctcaccgcagcctccacctcctgggctcgagcgattctcctgcctcagcctccggaggagctgggaccacaggtgcccgccaccacgctgggccgatttttacagtttttgtagagatggggcctcactgtgttgtccaggctggtcttgaactgttaacctcaagcgatcctcctgcctcggccatccagggtcctgcaatgatgggcgtgagccactgtgcctggcctattttttattgctgagggttttgcagaaatcatgtaagaagtggccggacgcagtgactcacgcctgtcatcccagcactctgggaggccgaggcgggtggatcaccagaagtcaggagttcgagaccagcctgggcaacatggcgaaaccccgtctctactaaaatacgaaagaaattggctgggagtggtggcaggtgcctgtagttccagctactcaggaggttgaggcaggagaattgcttgaacctgggaggtggaggttgcagtgagctgagatcgcaccattgcactccagcctgggcaacgagagtgaaactccatctcaaaaaaagaaaaaaaggctggacacagtggctcacgcctgtcatcccagcactttgggaggctgaggcggacagattgcctgagctcaggagttcgagaccagcctggccaacatgttgaaaccccgtctctactaaaatacaaaagaaattagctgggagtggtggcaggtgcctgtaatcccagctactcaggaggctgaggcaggagaattgcttgaa

SEQ ID NO: 1962 - DNA, 1050 bp, artificial
  synthetic oligo
tgacagatgattggttgtcagataattgaccgatagtaatggatagctgattaatagatagataattgattaatcaataattgatagatgatagataaagaatctctcatgcccaggcagctttctcagctctggcactgctgatgtttgggactggaggactctctgtcttggggccaccctgggtgctgcagggtgctaactctcttgatgaggccgtcctgggtactgtagggtactgagtctctgtgatgaagccgtcctgggctctgtagggtgttgagtctgagtctctgtgatgaggccgtcctgggccctgtaggatgctgagtctctgtgatgaggccgtcctggacactgtagggtgctgagtctgagtctctgtgatgaggccgtcctgggccctgtagggtgttaagtctctgtgatgaggccgtcctggacactgtagggtgctgagtctctgtgatgaggccgtcctgggcactgtagggtgttgagtctgagtctctgtgatgaggccgtcctgggccctgtagggtgttgagtgtctgtgatgaggccgtcctgggagctgtagggtgttgactctgtggtggggccgtcctgggcgctgtagggtgctgagtctctgtgatgagaccgtcctgggagctgtagggtgttgactctgtggtggggccatcctgggcgctgtagggtgctgagtctctgtgatgagaccgtcctgggagctgtagggtgttgactctgtggtggggccgtcctgggcgctgtagggtgctgagtctctgtgatgaggccgtcctgggagctgtagggtgttgactctgtggtggggccgtcctgggcgctgtagggtgttgagtctctgtgatgaggccgtcctgggagctgtagggtgttgactctgtggtggggccgtcctgggcgctgtagggtgctgaggagcgtccctgggctccacccagcagatgccagttcacccccatgttgtgacatgcagacatgtcccctgatattgctgagtgtgtccggggagggggcagg

SEQ ID NO: 1963 - DNA, 1900 bp, artificial
  synthetic oligo
gacagagagatacacacagagagacagagacagagacagcagacggagagagagagagatggagatggagagagacagagacacagagagagacagacacagagagagacagagagacaaagatggagagacagagacagagagacagagacacacagagagacagagacagagagacacagagagagacagacagagagatggagagacagagagacacagagagaggcagagacagagacagaaagacagagaggcagagacagagggagagatacaaagatggagagacagagagagacagagagggacagagagatacagatacagagagacgtagagacacagagagagacaaagacagagagacagagagagacagagagatacacacagagagacagagacacagagacagcagacggagagagacagatggagatggagagagacagagacacagagagagacagagacacagagagagacagagagacaaagatggagagacagagacagagagacagatacacacagagagacagagacagacacagagagagacagacagagagatggagagacagagagacacagagagaggcagagacagagaaacagagagacagagagacagagacacagacagagacagagacagggaaggaaggaagggagggagggaaggaggaaatgaaaccaaagaaaggaaagaaaaacccccaagagtcacaatcaatatacgtcctgcacaaattcctgcagtttccaggaggttcccgcagctccccggggcccgccaccccccgccaccccccacccactcccagagccgcctccttcaacaccccgacgtgcttcatctaccacgaggcccacggcggcttccggaatatgcggcaactttttattttttttttatttttattttttttaaggggtaaaaaaagataaagcaaacacggaacagcacactcctcccggccttccttcttctgacaccgttttcctttagaagatctgaaactacaagtcaggacatgacacgtggagcgtcccaggcacgcgcagcctctgctgtttgatttccgacgtgagtctataggtgaggctgacaggtttcagatggaagaggcagggcagacgcctttcaagagaggcgcgttgtctgggtaaatccatcaagggtgcgtcctgggagacgacgggccgcctttgtagacaacgccacggcacgggggccccccacgctgggcgcccaccccggctggctgacaggcggcccccgtttcaccgtgatcacgagtaaaagccagttccctgcaggttacggggctgctgtgttttgacattgaccttaatgcataatttaaccacaaagcatatgaggtacgtgcaaccagatgaggaaaggccacaggactggcaggtaacgtgatgctgaatcagaaaggatgtttgttcccgatcgtgcggacgtgggggcctctgccgaagaggcggagaggggaggagggggaggaggaggccgcggtcgtgtctgtcccagggctgtcgaggagaagtcggtctggggtcctggatgaggagcagagctcggggagctgttaacatttcctgggacagcgatgggcttggagagcctcactgtgcacacatgtggcctgttttttttatttttatttttagtttttgagatggagtctcgctctgttgcccaggctggagtgcaggggtgtgatctcggctcactgcaacctccacctcccgggttcaagccattctcctgcctcagcctcccgagtagctgggactacaggcgcccgccgccacgcccagctaattttttgtatttttagtagagacggggtttcaccatgttggccaggctggtctcgaa

SEQ ID NO: 1964 - DNA, 1350 bp, artificial
  synthetic oligo
ccagcctgggcaacagagccagaccctgtcttaaaaataaaataataattcaaaaaataggccaggcgcgttggctcatgcctgtaatcccaggactttgggaggcagaggtgggcagatcacctgaggtcgggagttcaagaccagcctggctaacacggtgaacccccgtctctactaaaaatactaaaatcagctgggcgtggtggcaggtgcctgtaatcccagctactcgggaggctgaggcaggagaatggcttgaacccgggaggcggaggtttcagtgagccgagactgcgccattgcaccccagcctgggcagcaagagcgaaactccgtctcaagaaaagaaaagaaaaaaaatgctcaggtacatttttgctttatttcaggatttctttacgttgctgtgaaaacctggatgttgggggctctgtctgtgtatcgtagacggagttttgaattgctccagtgaaacacaagtattttaccttacgctgtcaacctgctgggggaagcgtgaagacagtttaaccttctggctccggtaatcatcttgtctcagagacctcggagagctcccagagcctggctgccacggtggttctatataccctccagccctggcctgccttgggacacccctctccgcctgccggccccagaatttccccacacacgcggtcatcacagcccgagatgtttaatgacggcttcatgcaccaggctattgccctaaacacgggtgacaggccaaacacacactaattacctaactcaattcaagcccgcctggccccgtggaaaggctgagctggggatgcacgcaggtgccccgtcgttacctccggatgtcaaattgaagtgaggttttcccgcatgagcggggagagctgtttctacgcaccaagatttccacggtttgcaggagaaagagttttgtgtctgccctctggacagccctgtcagttttatcaagcgtgtctgattaaggaatatttaaaggtatgtgttcagaagcgtttctccccttcttttgtgtgtgtgtgtggccatgtttaaaaaaaacaaatgtaaaaccagttacaggcaaagtaggctagtttggtgctgaaataacgccgtcgttcatgagccggcttaaataatgcagttgttagaaaccagctctcaaagctgtgggttggctgaggagggttagtacgaggtcctgaccccaaacctgtgtgtatctggagccggcgggagacatttggcctggagtatgaggctggctggacctggaaggtcctcagcgttagagggactgtttcgggaaggttttctggcagctgagtcccaattccagga

SEQ ID NO: 1965 - DNA, 1150 bp, artificial
  synthetic oligo
acattcacgcgattttcagaattagcagccacccgtctgggtccccacagtgtttggggaaagggatttgggggtgtggtacgccctgtgttccccggcgggcagctggggccggactcccttgccgacatcctgtgtgttctctgcatctcgaagttgtcacgaactctcatggcaacccccttctcgtgctatgggttccgtttagcctccctcagaattagctaaaaacccaccggcttgatttctggcatttgcaacggccgcgctcaggaaacctcctgcctcctgaaaatgctcatgctggcggaacgggaaggcaaataggaatccgtggatgataaatgggcgttttaagcagcagtttacttaatatccctattaaacgagactctttgcattaatcacttcattctccagcagtctataaggccctttaattgcttcttaaatgaggactgagtttccgtccaaactcaatcttggatggggagagagagatgctagccagggctcagctgcccggctgccaagaactgtcagaattgatcacgtatgtgttcacgtttcctacagtctcattggagttctctgagattgacaggagaaagtatcacatactttgtgtgtgtgtgtgtgtgtgtgtgtctgtgtgtgtcagagacagagggacacagaggccgggagcaggggtgtgtaagtgtgaggttctgaacgcaaagacaggccgttctgctcacaatccacaggccagcgaccttgtggaccattgcattatgtattagcaatatttattttcattttatgattttatttatttgagacagcttcttggtctgtcgcccatgctggagggcagtggtgcaatcatagctcactgcagccttgatcttccaggctcaagaaatcttccctcctcagcctcccaactagctgggactacaggtgcatgccaccatgcctgtctatttttttttttttggaggcagggtcagtcacccaggctggagagcagcggtgtgatcttggcttaccacaacctccgcctcccaggttcaagcgattctcctgtgtcagcctcccgagtagctgggatgacaggcacccgccaccacgtctggctaatttttgtattttcagtagagacagg

SEQ ID NO: 1966 - DNA, 1500 bp, artificial
  synthetic oligo
actgcaacctccgcctcccgggttcaggcgattctcctgcctcagcctcccgagtagctggaattacaggcgcccgccaccacgcctggctcatttttgtatttttagtagagacggggtttcaccatgttggccaggatggtctggagctcctggcctcaggggatccacccgcctcggcctcccaaagtgctgggatgacaggcatgagccaccatgcgcagcccaaagtgactttttttaaccgtctctgccagcagacaaccgttttagagaaattcagtttttttaaattttttttgagcgcgttacattcctgagctgctgtctggggctgtcaaagccacgttgctcacctgaccaggtaagtcttggcttggactgtttcccaggacaaataacaggtgttttctcccattccctgccctgagacatgggagtgtctttgctggaattatagcaactgtgagcctcttcctggccgtcctgtcgccttggagtcttaagggaaggcgcacacgttatcacaaagcatatgcatttgcccctgggccccagaggtgctggattatgggggtacagggaaaagtctgtccacaccccagtcttctgggatccataggccagggagaaatcctccttctgtctccgagagtctgacagagacagcatgtcattatcttaacagctgtaaatcccaattatttctgaggcagaaaatgcactctaaaatatgcatgcttatttaaaaaaagagaaagaaaaaaaaaaccctcaaagattgcagtcgtgttgctataatttagagccctaaacctcagaacctccggatgagtcttcggcttgatattgtgagaccggctctttcaatcttggagggatatctcagcaaatgctcctcttcccgttctctgcaagtggggggaaaccgccgctgacccacggggtgacacgcagctgaatcattccaaagggaaccgggggccggattgatctgcgttggtcgctaacgaaggctcgtaggcaaagctcagcgaagtgggctcggcggacacagggtgggctcggggccccggggccgggcctgctggtggaggctggggatgtctttttgattttgtcgttaggaagccgtaccgtagtctctccgaggcgttgggtgaaattcacagatttcatcttccgtgaactgtggctcactttttgatatatatatatatattttttcccccgattgcttgatgtcaccctgtgctttttccataagacaaatgcaaatgagccaggcattctaacgaggcgagccctcggaggtgacctctttctggggaagctccggtctgcaaaaccacgatgagagaggaaaacgtttttttttttttttgcagagaaaactcaggcctgctgtttaatcagggcctttgctgcggccgctgctcctgcagacacagaggcgttaatgaggcaagactagtccccatgtccccacgttggaggcct

SEQ ID NO: 1967 - DNA, 1550 bp, artificial
  synthetic oligo
gcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcc

SEQ ID NO: 1968 - DNA, 2500 bp, artificial
  synthetic oligo
acaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgatgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccagg

SEQ ID NO: 1969 - DNA, 1450 bp, artificial
  synthetic oligo
cccgcggtgaatgacattacagagaaaggcatatccagagtgacacaaatgtatttctgtcccaagcaaggcagtctattttcatagaatcaaggggctatttgtctggggacgatttagtttccatgaaaaattaaaatggttttctgtgctgctatagggtggcgaaatttaatttgtcactcgtttactaaagcaggtataaaaaggagaagaattggatgtctgatgggctgaaattggcgacgtccctcggtttggtctcccaaggcctggggacgcagaggcctgtcccggccacccccaacgcccccctctccccaccctcggaggacctggtcatcttaaaccaacttacagaaaacctttggggaggctgtgccaatcacccggaaaaccacgttcctatcgatcccctgtctgcgtgatttatggcttcattttacggtaattgagaattagtgaggagatgagcaggactgcacgtggtgacacggggtccacatctcattgaattgcgggatgacgtggaaattaatgtgacacacgggagatgtggaacagggggccgtgtgtctccagcatcacacgggcgtccccggtcaccagcaccccctccccggtctgccttcgaaggcaggatgaggatgattgatccgaatcggtttcaatccgtctcaactgcagcccggccgatggacgggacactcacaattggattgagcctcctacgaacaaagttcatcgacagccacccgcaggtcaatggctgcagctcaccagcgtggcacacgtatacgtatgtaactaacctgcacaatgtgcacatgtaccctaaaacttaaagtataatcataataaaataaaataaaggaaaaaaaataggaggtctcgtgtcatccgaccgcctcaaaatgaagttttgaaaatctacgtcttgcagccgacatgccaaatctctaaagccaaccaacagtggcaaagtcgaattacagatggactctgctgggctgtttacaggataatcggctgctctgatcgtgaataaaggtgctaactactccccactgtgcagagagaaaaaggttctaactacccccaccctacagagagaaatgtctgcgtcccgtaagggcaggaggggtgacagaggagatctgggaagctctaggggtgaaaagaggcttatgtctggcctcagccatctctccaaagccttacagaggcctcctctgcagatttgcacacctaaagctcggcggggtttcaagaccgttaagaatctcttttgcatttgaacagggacgtaggtgtgaacgtagagtgtccagcagaaaaaaaaacaaacaaacaaaaaaaaaaaaaaacggagctgtggaaagttccggagaagctcacagtgtaacagtgggaaattcttcaccttctggtgctcggcaaattgtttgac

SEQ ID NO: 1970 - DNA, 1650 bp, artificial
  synthetic oligo
tggccagaggttcccggaataaattagccaagcggagttgctgagtgcgggaggaggatgaattagaagtccgacgctgtgtggggaaaataggctccacctccccgagctcaagccttcccgggcgctgggactacaggtttgcaccaacacacctggctaatttttttaaattgtttctgttttgtagaaacaaggtctcagtatgttgctcaggctggtctcaaactcctggcctcaactgatcctcccacctcagcctcccaaagtgttgggatcacaggtgtgagccacggtgcccagcccaggaatgaggtttaattcttcacaacgcgttattccaggtcaaaggtagtcccacccccagctaaatctccatgggtagaaactgaaatgtcttcctttggaaaaagcagctaagccagcagaactctgatcattggctgtggtggtagcttgactatgtcccccgaaagagacaggatcataaggtcaggagttcgagaccagcctggccaacatggtgaaaccccgtctctactaaaaatataaaaaattagccggacacgggctgttttaacctgtgctacctatgagtgggactttatttggaaataaggtttctgcagttggaattaagtgggggaatttgagatgagatcatcctgcattagggggaccctaaacccaatgaggaatgtccttctaagagacagaagaggaaacacagacacagaggagaaggccacgtagagacggaggcagagactgcagtgaggcggccacaagcccagggatgcctggagcccccaggagctgggagagttaggaaggaccctcccctacagcctccagagggaacacggccctgagacaccttcttctcagactgctggatgccaggactgggacaggaaaaattcttgttgtaaaagcttctgggtttggggtcatttgtgtggcagacgtaggatgtcagtcaccaggagatcacggatcaaagccgagaaacactgggatgagggccctaggttatccacaggggcctcgatgaatgagttggatgtttcctcatgtgtagcagtgcacagaagggcaggaggaactgggtaccaggctgactttacctttcgcgtaaaagcccgtccaagagtcacaccgaatgtgtttctggttgttttttttttttttttttttggagatggagtctcgctctgtcgcccaggctggagtccagtggtgccatctcagctcactgcaacctccgcctcccgggttcaagcgattctcctgcctcagcctcccgagtagctgggactacatgcacctgccaccacagctggctaattttcatatttgtagtagagacggggtttcgccatgttggccaggctggtcttgaactcctgacctcaggtgatctgcctgcctcggcctcccaaagtgctgggatgttgcaggcgtgagccaacgtgcccagtgtgtttctgttaagacacgcgaagccgtggttctcccctgggctccgtcctcttgcttttgctttttgagttctccagtaatacgagtaccctttactttttgtatcccattttttatctatttttttctctcttttgggtgtctgcaacaacctggctggctcggctc

SEQ ID NO: 1971 - DNA, 1200 bp, artificial
  synthetic oligo
gacagaggaagagagaaagacagagaaagagggagggagagacagagacacacagagaaagaaacagacagagagacagaggaagagagagagagaaagagggagggagagacagagagacacacagagaaagaaacaaagacagagagacagaggaagagagagagagaaagagggagggagagacaaagacacacaagaaagaaacaaagacagagagacagaggaagagagagagagagacagagaaagagggagggagaaacagaaacacacaaagagacagagagacagagggagagacagacagaaagagagagagacagagagagagaacagaaagaaaagaagagacagagagagaaagaaggagggagagaccaagagatagacgggggagaaagagacacagagagatagagaaagagacagacagagggagagagagggagagagagagagaaagagggaggaagaggtagagacagaaacagggacagaaaaggagagagagagagaaacagaggaggaaagacagagagagacggaggcctggctacaccagacaagacctccaggcaggtgccctgagcccacacaagctctcatagatgcgagggccccagctgtgcagggtgtgagcaggtcttccagagacgggtggccccatggtgttgcaggtgcctgggagatttctccagcagcgcggccgtccggggctgtgtccctgggtcccagtgcagccacgggcacctgcctctgtttctgatttcacgtcgagacctgctgtgtggatgggaacctcatgccccctccaagacactggagaatctgagctactcagcctcagccttctccccgttaacactgataagagtggagtgagcaaccccacagccctctttgataaccagcaacggaaattttagtggattgttgtgaggtgtggacgctcttccaaatcataaccctggtctaatatttcctggaaactcaagaggcctgcgggcgtctgtcagacacgcccagtgcatccctcacttctgcttaatctgtctttgatgtgtgatgacctgcagggtgtacccttgacaatccttgcgtttcctcccgaaacacaatcaaagcgtgaaccgggttcacaccgtaccgggatctcgagtttcccttcagacaggaggaaggcgccagcaacagcca

SEQ ID NO: 1972 - DNA, 1500 bp, artificial
  synthetic oligo
gattacaggcagctgccaccacacctggctaatttttgtattttagtagagacggggtttcaccatgatggtcaggctggtctcgaactcctcacctcaggtgatccacccaccttggcctcccaaagtgctgggactacaggcgcccgccaccacgcctggctaatttttgtattttagtagcgatggggtttcaccatgatggtcaggctggtctcaaactcctgacctcaggtgatccgccagcctcggcctcccaaagtgctgggatgacaggggtgagccaccgtgcccggcctctggtttgcaattgtgactgagctggtaagaggtgggggccaagggttctcaatctgtttttttaatttttgtgttttgttttgttttgttttcgagacaagatcttgctctgttgcccaggctggagtgcagtcgtgcaatctcagctcagcgcagcctccaccttctgggctcaagccatcctccttcctcagcctcccaagtagctgggactatgggcattcataccacatccagataattttttttttttcttggtacagacagggtttcaccatgttgcccaggctggtctcaaactcctgggctcaggcatcctcagccttggcctctgatagtactgggattataggtctgagtcacagggcctgtctttttgtttttgtttttgtttctgttttgtttgtttgttttgagatggagtctcgcccaccgaggctgaagtgcagtggcgtgatctcagctcacggcaacctccacctcccaggttcaagcgattcgcctgcctcagcctcccgagtagctgcagttacaggtgcccgccaccaaacccagctaatttttttgtatttttagtagagacacggtttcaccatgtcggccaggctggtctcgaactcctgacctcaaatgatcctcccacctcagccccccaaagtgctgagattacaggcgtgagtcaccgcgcgcccggccactgtttttcttttccttttcttaaataacagcaccattgcacagctcatgagcgctacagaaaacacatgttaaatgttttccaccaaattttggctttttattgcggttgaaaataaacaagtaccagaaaatcagatctttttgtaaaatgttaaacacacattatgggtaatgtacacgcctgtggcttcctgtacggccacagggtaattgaatttgattcgagttcatttactcctgccaaatcaagccccaccgaacaggtgttagatgttgttagagattcagctttgaaatgtccatttctctcttcctttcaacttctggatgtgctgaactggggaaaatcctgtgagtataatttacatgttcctgctgccttccacgctacggtatcggagcacctgatgacttctttatatggggcatatgaaagcaaactctgaaatgaggccgggcgcggtggctcacgcctgtcatcccagcactttgggagaccga

SEQ ID NO: 1973 - DNA, 4500 bp, artificial
  synthetic oligo
cagggtgctctcaaactcctggcctcaagagatccacccgccttggcctcataaaatgcttgcattacaggcatgaaccaccctgcccagtcctaaatttgctttttacaggggatgcctttgcaaaggtagcctgaagctacatcagggctcttgtacatgagctggtcacatgagagtctgcctaaaagtagaagaaggaaaaaaaaaatcgcagtcctccaaaggctatgataaccaagggaagtcatcccaagacgtgtgagtggctggattctctatatccatccaggagagaggattgggggtcactgggagcaaggtttatcgtgagacaacttgagatgtcttcctgcgggcacgaaaaggaccaaaacactctggaataggattgcttggggcagaaaggtcttcagctgaccacatgctttctgagcacctggctttacgcagaaccctgtccgggaaatgctgggtgaagagaacacgctgtccagtgggcttgggagggcctcatcttgtgccggcttcagccaattggaaaaaaataaaagatgagccgattatgtaaggcctgacatggtactgagggctctctgagcataaattaacttccccacacagcccgcctgtgaggtaggtaggaaggtgggcggtaaacgtgtgtgccaattttcatctggacctcagagacccatggtagttcagcaaaggccacacagtgagctgggtggagggaacgtagaaactctcaggcatccgccaggccccgtcccatactttggcagggaggtttttattaaaatgattaaggaccgaggtggtgatcccgggaaaagttgttgaaaaatgaaagtttgggcctctgagttaatggtttaattatgcgtctcaggatttgcaaagagcacagtcatcttatgtgtggggcggattctgacttcccgtccagcctttcatttctagagacaatcggccaatttatacttaggggaaaatgaaggacgagctgaaagaatggcagaaagtccatcttccaagctcttcctggaaatacagaaaagaaaggagcgtcctcaaaaaacaccagcccacacgttgacgtcggcacctcctgcaagatgagccgggcacatttattaagcagccgtttggctggaaaaaatggccaatgcaactcggtctgaatttctctcctgggtgtccaaggatcaaggcaggtaatgaggttggcagaattatgaatcgcaatcaaattttttctatgacctgatagaaacgccaactcactgtatgagtctgttgtcaaagtctaacttccaaaacgcaaagcacgctcccgatcataaacacagagatagcagtattgaagaattgtccccccggctccagccccggatttctctagaggggctaatggaggccacgacatttgtggcataaaaaggtttgcgatgaacagtcttgcctggggtgcaggaaggtgaggagctgtgtgtggcttttgcgttttccttcacgatggaatgcgagtctttgatgccggctagatccacgttttatgaggcggaatttttaatattgaaagtcagaaagggctagatggtctttggagtcccagtgggtgaagtcgaagtaaaggaatgtggtcattaaaaaaaaaaaaaaaaaacttgatttttcttacccagaggttggtacacggtgagtctaattttctcaaaggaaatctgaaatcagaccaatttggagtgtcgttagctgggatctacctccaacgggcccacatcaccaaccctcatgtcgggcaccgaatttccgtcactattctgcaggatgagctcacgccaggaatacctccaccaacccaatgtctgactcaaaactttgcaaactaggaaaggcccaaagaaattatgaaatcagggccgggcgcggtgcctcacgcctgtcatcccagcactttgggaggccgaggcaggtggatcagcagatcaggagatcaagactgtcctggctaacatggtgaaaccccgtctctactaaaaatacaaacaattagccgggcgcggtggtgagcacctgtagtaccagctactcgggaggctgaggcaggagaatggcgtggtggctcacacctgtaatcccagcactttgggaggccgaggcaggtggatctcttgaactcaggagatcaagaccagcctgggcaacatggggaaaccccgtctctactaaaaatacaaaaattagatgggtgtggtggtgggtgcctgtaatcccagctactccaggggactgaggtgggaggattgcttgagcccgggaggcggaggttgcagtgagcagaaattgcaccactgcactccagcctgggtgacagagtgagactctgtctcaaaaatgaaaaaaaaaaaaaaaagaggtggggtgcagtggctcacacctgtaatcccagcactttgggaggccgaggcgggtggatcacgaggtcgggagatccagaccagcctgaccaacatggtgaaaccctgtctctactaaaaatacaaaaattagctgggagtgatggcgggtgcctgtggtcccagctactcaggaggctgaggcaagagaatcgcttgaagttgggagtcagaggttgcagtgagccgagatggcaccactgcactccagcatgggcgactgagtgagactccgtctcaaaaaaaaaaaaaagaaagaaagaaaaaagaaagaaagcgaaagaagaaggaaagaaagaaagcgaaagaagaaggaaagaaagagaaaggagaaagacagagaaagaaggaaaaatgaaagaaagaagaaagagaaagaaagaaagaaagaaagaaagaaagaaagaaagaaagaaagaaagaaaagaagaaagaaagaaagagaaagaaagaaagaaagaagaaagaaagaaagaagaaagagaaagaaaggaagaaagggctgggcacagtggctcacgcctgtaatcccagcactttgggaggctgaggcgggtggatcctctgaggtcaggagatcgaggccagcctgaccaacatggagaaaccccgtctctactaaaaatacaaaaattagccgggcgtggtggtgcatgcttgtaatcccagctactcgggaggctgaggcaggagcatcgcttgaacccaggaggcagaggttgccgtcagccgacgtcatgccaatgcactccagcctgggcaacaaaagcaaaactccgtctcaaagaaaaaagaaagaaaaaaaaaagaaaatcagagactccctggcagatctcagggtatgactcccccagggtcgccatagctgactgcattagcacggccctgtgatcaccggatgaatggtcttggtgggacaggtggctgccgtgatcaaacggcgtgtccgccggtgctgacaggtgaggtgcggagttgcccacatggcccgcctgggcctggtccaccagcagcagggaaggaggagcagagcccagctcggtgcatttggaggcggttaccagggaaaccagaggacaagctcagacgcttggggacggcctctccacccaggcacgtggagcttcatattaatcggcagccgggcacgggctggcagccccttacccagacagatacacacagaagtggagctcccagtgatggctcgtcacggctgatatctgccccagtggtcatgttgaaccgggacgtcatctctgtaggaaaagggggacggatgtctgtctggacacggtccaaggtacatcgctgtctgatctttccgaaaagtcagcgttcgtggcttgagctggacgctttgaaaggcgagggcgtcggaagcttcatctcagggagctgtcatgtggtattagcttgtagcaccaccaacctgccctgcccagactgacttctccagggcgggttttccaggaggaagcgcagggtgactctgtttccccagcggcttccaagcactcctggggacctctgtttgtgagaaggacaacatctgtgtctgtctgatgggcttggtgggatactctgatgcatgcacctgccgccggagctctctctgcaaacgttctgtgctgacttaggggaggcaaagacacagagttggagatcaaggctggtttgttcttcagccttttgactcttcatctgcggcatcattgcatctgtttgaatatttttcaaaaagtttatcgaaaacacagctgcactccgacgaagatccccacactattcacaatgggaaacatatataatcgaccgacgtgtgtttcatttgcttttccctgatgattattgattgtcttagtccgttttcatgctgctgataaagatacaaccgaggctggggacggtggctcacgcctgtcgtcccagcactttaggaggctgaggtgggtggatcacctgaggtcaggagtttgagaccatcctggccaacatggtgaaactgtctctactaaaaatacaaaaattagct

SEQ ID NO: 1974 - DNA, 1400 bp, artificial
  synthetic oligo
gtagtattccatggtgtatataaaccacattttcattttcttttcttttcttttttttttttttttttttgagatggagtctcgctctgttgcccaggctggagtgcagtggtgcaatctcggctcactgcaacatccgcctcccgggttcaaacatttctcctgcttcagccttccgagtagctgggatgacaggcagccgccaccatgcccagctcattgttttgttttgttttttctatttcttgtatttttaatagagtcagggtttcaccatgttggccaggctggtcttgaactcctgacctcaggtgatccacccgcctcggcctctcacagtgctgggatgacaagtctgagccatctcacacctgtttcttttccttcttaatgggcatgtaaaattgttctgcaacactcctggctcttctgtggaagtgtgatgtccacgagaaggaatttagggagagcaagcttgcttctgcagtccccgggaaaggcaggtctgcatggctagcggggtcaagctctcgtaggaaggaaagaatgctccaagacatgctctgaacccaggaagaacgcaagcttcggctccgaagcgttccgaggaggccaagctgcctctaatcaccccgaattatccgtaaggggaggcgtcggggagctggtaatccgtggggatggaagctaattacttaatcactcgcatttgtaaatcgcattattggaaaagaaattactctggtgatcgaattacagatatttatctgctaatagccctgattaactggcgatgttaatctgtcattttgaaagctaatattaacagcatcaatctcgccgagaaaataaacagtttacgggaaataaaaccgggtgtaatggaaagcaccgtgtgtcggagtccccagatctagagtgtgctgctgagtgcagtggccaaggtccccccgttagccctttatggaaaataccctctggctgggaacggttcggacgaggctgactctaacgggctcagagaagctgaggagaaacacccggggaaaatgcattttgagaaaaatcccaaaggttctagacacgggtcccccagggaacgccctgcacgtgtatttatgcagagttcactctcgataaaaaggatcccctggaattccaagcaaggaaggattgagctatccagcagacacccggtgggtgcattttacgtcgcctttagccaaatcgatgatctcagagtgagactcagagtgaggctccggctcaaagaaaaaaaaaaaaaattaccaaatagtgtcaaaaccatagctatgtcttttctcagacaacaatttgataatgcttctttttggaaaattagcaagatttgaggatggggtttggatttgctcaagaac

SEQ ID NO: 1975 - DNA, 1950 bp, artificial
  synthetic oligo
atttttgtatttttagtagagatagggtttcagcatgttggtcaggctggtctcgaactcccgacctcaggagatccacccgcctcggcctcccaaagtgctgggattacaggtgtgagccactgtgcccagccttgtttttgagacagggttttgcttttattgcccaggctggagtgcaatggtgcgatctcagctcactgcaaccttcacctcccaggttcaagcgattctcctgcctcagcttcccaactagctgggattacaggcgtgcgccaccacgcccagctaatttttgtatttttaggagagacagggtttcaccctgttggtcaggctggtgtcgaactcctgacttcaggtgatctgcccgcctctgcctcccaaagtgctgggattacaggcatgagccaacacgcccggccagcgtgtgtgtttcacgaagctccctgtgatgacaaggagctgtggatgatgaagaaacttgtatttctcagcagcagaattttcaggccttcatctccacgttctgtggattcgaaatgatgcctcatccgggccattaatttcagcccttctatagcgctccttacacacgataatcatgtccatttgggcactgacttctctagatggcatctcaccagagactaagtactgggtgctgacaattgataggaaattcagtctgcggcagttaatatatggaaacgcgatttgtacttaatcatcccactgggagtcctaagggcaagtaagtggatgcaggcattttaaaatgcacgggtgggttacggcaacctcacttgccacaggctctcttccccatagacagctgaagagctgaataaataaggtacgtttccctggcgtttgacccaacgcctgtgtcttcttccccccgaccgcacctgccaggcgactaacacctttcagggaggctcacataactaggcaggtccacggctgggatttgcagactctcatgctgacgagcatagaccctgacactcatttatttaccgacacagagatctcctttttcgttagaatagaaatttgtaggcgaccggctccttcactgtttaatattaaaggatcagagacaatgcctgggtggggcgaagggagggggatgtgacaatttgcagggtgacttacccggcttcctgtgacaccagctaattggaaggggcagtaatgatgttctgttttggtccctgggaccccaggatggggctgagagggtatttttagaagttggccgtgcttacatttttgaggaacctatgactttttttggttgactttattcctttttatttaaatttaaaaacacttcaaagtacaaaaatacaagtgcttcaaaacagacagatgggccgtgcacagtggctgacgcctgtcatcccagcactttgggaggtcgaggcgggcggatcacttggggtcaggagttcaagaccagcctggccaacatggtgaaaccccgtctctactaaaaatacaaaattagctggacgtgctggtgcgcacctgtaatcccaggtacttgggaggcggaggcaggagaatctcttgaacccgggaggcagaggttgcagtgagctgagatcgtgccactgcactccagcctgggcgacagagtgagactccatctcaaaaaaacaaacaaacaaaatatagatgggtttgtcccaaatataaactttcttatttcttatatttctccaaaaatccctcttcatccctgtttatgattttaattctaccatttctctatagatgtatactgcttttataatcataatttaaaattttatcctgcgggctgtgaatggtagctcatgcctataatgccaggactttgggagggcgaggtgggcggattgctggagcccgggagaaatttgagaccagcctgggcaacatggcgaaacctcctctcta

SEQ ID NO: 1976 - DNA, 1050 bp, artificial
  synthetic oligo
ctcaacctcacaaagtggagggattacaggcatgagccaccatgccgggctgtgtttcttaattaatgtctgtacgttgtttttttaacatagcggtattgcacacataccagactacagtctaagcaaggtgtatacgcagtaggaaagtaaaactgtgtatgactcgctttattgggacatgagctttatagggatggtctctgcacatcaatttgcactttctccaaggcacgcctggatggggtgatatccacgtctgcgtccttaaaatgagggacggtcatctactttcgacgatttcctttgctgagctttgccgagcaccgtgacaaatcagctgagctcgcagacacaccatgggtaagtaggagatgattgtcatccaagggctaagttaatcccctctttcatatttaccttacacttaccagctcccactttaaggtccattaaaataaagctctctgagtccccagagaaacggctctcaccagtgagcccgaggggaaaacgtgtcagtcaagctattattggtgctaattagctgctgtgccggctgagagaaagcacggctgcagacacgtgtcagtcagagaggcatctttctccccgccttggcacgcatctctgcctttttgccatcttctgcctttggtcatcttctgcctttggtcatcttctgcctttttgccatcacggaaactgtctccaaactaagcaaacaggtctcagggatcaacaggaatgatatccaccctcctgagggttcctttgctcctggatcttgaatactcccagagacccccaactgtaggccaaaagccgatgccaggtctgcagaggaggcccctgtgaaaatggccagctgataactattattacgttgctttttttcatttggaaagtctgtgggagtgtccccgagtttaagtcaggaaggaacatttaaaaacagaatcttccggccgggcacggtggctcacgcctgtcatcccagcactttgggaggccgaggcgggtggatcacctgaggtcaggagatcgaga

SEQ ID NO: 1977 - DNA, 1450 bp, artificial
  synthetic oligo
agccaccgcgcccagccaggaaggggtttaatggactgacagttccacataggggacgacaaaagtcacatcttctatggcagcagacaagaaaagagagagagagagacagagacagaaacagagagaaagagagagacagagacagagagacagagacagagagagacagaaagagagagagagacagacagagggagagagacacagagagaaagagagacagagagacagagagagagagacagagacacagagagacacagagacagagagagacacacagaaagagagacagaaagagagagagaaagagagacagggacagagagacagagagagaaagagacagagacagagagaaagaggcagagagagacagaaacagagagagagagacagggacagagagacagagagagagagagacagagagaaagagacagagagagacagaaagagagagacagacagagggagagagacagagagagagagaaagagagacagagacacagagagagacagagacagagagacacagagagacagacagagagacaaagagagacagagagacacagagagacagagagacagagacagagacagaaagacagagagagagacagagagaaagagagagagacacagagagaaagagagagacagagagaaagagatagagacagaaagagagtgacagagacagaaagagagaaagagagagacagagagacagggagagagagacagagagagacagacagagagaaagagacagagagaaagagacagagagacagacaaagagagacagacagagagacacagggagagacagagacagagagagagagacagagagacagggagagacagagacagagagacagagacagagagagacagagacagagagaaacagagagacagacagagagacaaagagagacagagagacagagacagagagacacagagagacagacagagagacaaagagagacagagagacagagacagagagacacagagagacagacagagagacagagagagacagagacagaaagagagagagacagagagagagacacagaaagagagagacagagacagagagaaagagatagagacagaaagagagtgacagagacagaaagagagaaagagagagacagagagacagggagagagagacagagagagacagacagagagaaagagacagagagaaagagacagagagacagacagagagacagacagacagagagacacagggagagacagagacagagagaaagagagagacagagagacagggagagagagacagagacagggagagacagagacagagagagagagacagagagacagagacagagagaaacagagagagagagacagagagagacagagacagagagagagaaacacacag

SEQ ID NO: 1978 - DNA, 1150 bp, artificial
  synthetic oligo
cgctggagtgcagtggtgcgatcccggctcactgcaagctttgcctcccgggttcatgccattctcctgcctcagcctcccaagtagctgggactacaggcacctgccaccatgcccggctgattttttgtattagtacagacggggtttcaccgtgttagccaggatggtctccatctcctgaccttgtgatccgcccacctcggcctcccaaagtgctgggattacaggcatgagccacagcgcccggccaagtctctcactgtcaaagaagtcagttacaggtttggaaagatggggtacagtgaaccttgtcatgttgggttctaagtggaggtatctggaggatagatagatacagatagatagataaatggtaatgttagatagatagaattatatagatgatgatagaaatagttagacagacagacacagatagatagggatgggtaggtagatggatgaatcaatggacaggtgggtgtataggtggaagacaagtggatgggtgggtggatgggtgagtggatggatgaataaatggatgaacagatacacaggtgaatgggtggatgggtggatggatgcatggatagatggatacatagatgtgtacatggatgggtggatggatggatggatgagtggatgaaagtgtgggtgaatgcataggtggatggatggtttgatgggtgggtggatggatgtgttggtggatggatggatagatggataagtggatgaaaggatgggtgggtggatgagtgagtcagtggataaataaatggatgaacagatacataggtgaatggatggatggatggatggatggatggatgcatggatagatggatacgtagatgtgtacatggatgggtgggtgggtggatggatgggtggatggatggatggatggatggatggatggataagtggataaaagtgtgggtgaatgcatggatagatggatgtattggtgggtggatgggtggatgggtggatggatggatggatggatggatggatggatggatggatggataagtggataaaagtgtgggtgaatgcatggatagatggatgtattggtggatggatgggtggatgggtggatggatggatggatggatggataagtggataaaag

SEQ ID NO: 1979 - DNA, 1250 bp, artificial
  synthetic oligo
gaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaaga

SEQ ID NO: 1980 - DNA, 1250 bp, artificial
  synthetic oligo
gcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctga

SEQ ID NO: 1981 - DNA, 2700 bp, artificial
  synthetic oligo
tgagatggagtctcgctgtgtcacccagagtggggctgtctttgacatttgtttgttttttgttttttttttgagatggagtctcactctgtcacccagagtggggctgagtctctgagatttctattttttattttttttttttgagatggagtgtcgctctgtcacccagagtggggctgagtctctgagatttctattttttttttttttgagatggagtctcgctctgtcacccagagtagggctgagtctctgagatttccaattttttttttgagatggagtcttgctctgtcacccagagtggggctgagtctctgagatttcttttttttttgagatggagtctcactctgtcacccggagtggggctgagtctctgagatttctttttcttttttttttttttttgaaacagagtctcactctgtctcccaggctggagtgcagtggcgcgatctcggatcactgcaacctccgcctcccgggttcaagcgattctcctgtctcagcttcctgagtagctgggatcagaggcgcgccccaccatgcctggctcattttttgtattttagtagagacagggtttcgccatgttgcccaggctggtcttgaactcctgagctcagtcaatccacccgcctcagcctcccaaagtgctgggattacaggcctgagcctccgtgcccgactgactactcctggtttaattcatcccaggcaaatgcaggctggatatgctgggacccctctttcatggcaaagaggtctttgtagatgttgttaagtaaaggatcttgagatgagatcgttctggaggggggtggccctaaatgcaatgacaggtgtgtttctaagagacagaaaaggagacacagacagagaggaggaggccacgtggagacggaggcagagactggagtcatgcggccacaagcccagggatgcctggagcccccaggaggcgggagaggcaggaaggaccctcccctagagcccccagagggagctcaaccctgagacaccttttttgttttcttgttttttgcttttttttgagacggagtcttgctctgtcacacaggctggagtgcagtggcgccatctcagctcactgcaacctccgcctcccgggttcaagccattctcctgcctcagcctccccagtagctgggattacaggcacccgccaccacgcctggacaatttttgtattttttaacagacacggggtttcaccatattggccagtctggtctcgaactcctgatctcatgatccgtccgcctcagcctcccaaagtgctgggattacaggagtgagccatcacgcctggcccgaccctgagacatcttgatctcagactcctgacctccaggactgggggataggatgttgtgatcaaggtgcggcttctggcatggagattggcaaggcccgagattgctccagcaggcacacaggagggctgcgtcaccagagggagacctgaggtctccagccatcacccaggctgcggaagagcagcggacggaaacccagaggaaggttaaccaaagccaggtcccatcccacttacctggccactgtgcacccctcaacatcctcacaagggatgcctcagcctcccgcctagctgggatgacaggcacctgccatcatgtccagctcatttttttctttttctttttgagacggagtcttgctgtgttgcccaggctggagtgcagtggcaccatctcagctcactgctacctccgcctcccggggttcaagtgattcccctgcctcagcctccccagtagctgggaggcagaggtagcagtgagccgagatctcgccactgcactccagcctgggcgacagagcaagactccgtctccaaaaaaagagaaaaatttagctggacatgatggcaggtgcctgtcatcccagctacttgggaagctgaggcaggagaatggcgtgaacccaggaggaagagcttgcagtgaggcgacatcgcaccaccaccctccagcctgggcaacagagcaagactccatatcaaaaaaaaaaaaaaaaatatgagctgaacatgatggcaggtgcctgtcatcccagctactgcggaagctgaggcaggagaatcgcttgaacccgggaggtggagcttgcagcgagcctagattatgccactgctctccagcctggacgacagagcgagactccgtctcaaagaacaaagaaaaagtcggctgtgctcctggcatgggtggcacacatacgagggtctgcacacacaggtgcacgccttgctgcgttaaggaggttctatttcgggtgtctcccatctgtgttatctcccagactcacccaccatcccttctcatttccttgtttctgttcctcctgcccaagtcctgccaaggccgccacccctcccgcaagcttctgaagctattcccaattgcctccctcctctgccaccagcccaaggagtttttcagaatgacccctgctgggtgcgtggctcacgcctgtcatcccagccctttgggaggcagaggcagatggatcacctgaggtcaggagttcaagaccagcctgaccaagaagctgaaaccccttctctactaaaaatacaaaaattagccgggcatggtggcgggcgcctgtagtcccagctactcgggaggctgaggcaggagaatcgct

SEQ ID NO: 1982 - DNA, 4800 bp, artificial
  synthetic oligo
ctcagcagttgacctgggaccttaacagaaatgtgaccgatatcgagtgtgttaaagacgccgactattctatgccggtaaatcatactctctattgtttttttatttttattttatttatttatgtatttatgtatttatttattttttgagacggagtcttgctctgtcgcccaggctggactgcggtgacccgatctccgctctctgcaacctccacctcccaggtccatgccattctcctgcctcaacctcccgagtagctgggactacaggcgcccgccaccatgcccggctaatttttttgtatttttagtagagatggggtttcactgtgttagccaggagggtctcgatctcctgacctcgtgatctgcccgcctcggcctcccaaagtgctgggattacaggcgcgagtcaccgcgcatggcccagactctctaatgttgacgaacaagacgtttccgtcttctgcaggaatctcagaaccaatactgctcccatcgctggtgtcatgactacctggtttctgccccgaagtcaggtgtgggatttgaagtgactttggagggtctggttccccgtccgcgggacatctaagatggcacacactggacagggtggatgtgaaagtgaaatgaggctaagctatgactggtgcgaaacccaaccccacgctgggcgtggtggctcacgtctgtaatcccagcactttgggaggctgaggcgggcggatcatgaggtcaggagttcgagaccagtctggccaacacggtgaaacgctgtctctgctaaaaatacgaaagttagccgggcacagtggctcacaccagcactttgagaggctgaggcggatggatcacctggggccaggagttcgagactagtctgggcaacatggtgaaaccccgcctccactaaaaatataaaaattagctgggcatggtggtgggcgcctgtaatcccagttacttgggaggctgaggcaggagaatcgcttgaacccgggaggcagaggttgcattgagccgagactgtgccactgcactccagcctgggggacgagagcaagacttcatgtcaaaaaagaaaaagaaaaattagccggatgtggtggcacatgcctgtaataccagctattcaggaggctgaggcaggagaattgcttgaacctgggaggccgaggttgcactgagccgagattgtgccactgcactccagcctgggtgacagagtgagactccatctcaaaacaaaaacaaaaacaaaagcaaaaacaaaacaaaagtgtgtgctcaggaaacaaggtcctcatcacgaaatccttccaaatcccccatcttgtcatcacctgcgttctcagggtttgagaacagcgccagacctcatggggtggcccaggtgacactgtgagctatttacaagtcagtgtcttatgggaaaggagcacgtttccctgagaacctatttggtcccctccaagagctatgttcgttcaatacaattcaaatcacggcccttcatgcgtctgctcgggccaccattataaaatcctacccccagctccaaatacagtcccattgaactttgtgattttggagagtagagataaaacagtctagaatcccagagcgattttaccataccatggcaaactgactctcaactttagaaacacaaatgctgaaaaaaaaactaaggaaattttgaaaaagaaggtgaatgaaggagaacctgccttacctatatcaaaaggcactgaaaagttcatacccaatgtgcggattgctataagaatacacaagtaggccgggcgtggtggctcacgcctgtcatcccagcactttggaggccgaggcgggtggatcacgaggtcaggagatcgagaccctcctggctaacacggtgaaaccccgtctctactaaaaatataaaaattagccgggcgtggtggctggtgcctgtagtcccagctactcgggaggctgaggcaggagaatggcttgaacctgggaggcagaagcttgcagtgagccgagatcgcgccactgcactccagcctgggcgacagagcgagactctgtctcaaaaaaacaaaaacaaaagcaaacaaaacgaagaatatacaagtagattaatgaaatgtggccgggtgcggtggtgaggcaggagaattgcttgaacccgagaggtggaggttgcagtgagctgagatcgcaccactgaagtctagcctgggcaagcggagtgaggccctgtcttaacaaaaaaacaaagaaacaaaaaacaaacaaacaagaaaaaaacaaagcaaaacaaacagaaaagtatttcactaatatttactgctaagtgggattatttttattcaagcttttgtatctttagaaaaaaattgtggccgggcgcggtggctcacgcctgtcatcccagcactttgggaggccgaggagggtggatcacgaggtcaggagatcgagaccctcctggctaacacggtgaaaccccgtctctactaaaaatataaaaattagccgggcgtggtggcgggcgcctgtagtcccagctacttgggaggatgaggcaggagaatggcatgaacccgggagggagaggctacagtgagccgagatcgcgcccctgcactccagcctgggcgacagagcgagactccctctcaaaaaaaaaaaaaacagaaaaaagtcttggccgggcacggtggctcacgcctgtaatcccagcactttgggaggctgaggcaggcggatcacatgaggtcaggagttcgagaccagcctgaccaacatggtgaaaccctgtctctacccagaaaaatactttaaaaattagctgggcgtggtggcgggcacctgtaatcccaggtgctcgggaggttgaagcaggagaatggcttgaacccgggagggagaggctgcagtgagccgagatcacgccactgcactccagcgtgggcgacgagagcgaaactctgcctcaaaaaaaatctgaacatcattagcgtcaaattaagcatggtctgtcagcagccatcatagtcctatgtctctcttaggcagtgaacaatagctattgccagtttggagcaatttccttatgtgaagtgaccaactacaccgtccgagtggccaacccaccattctccacgtggatcctcttccctgagaacagtgagaaaaatgttcattgtttgtttattctctattccctccctccttccctctctccctccctctcgccttcgctgtgtcttttttcttttctttttctctttctttctttctttctttctttctttctttctttctttctttctttttctttctttctgtttctgtttctttcttcctttctttttctttctttctttccttctttcctctctttcttttctttctctttccctccctcccttctttcttttcttcacttccttccctccctccttctctccttttcctccctcctccttcccaccctacttcctctctctccttccttccctttcgttttcttttcctccctgcctcactcccttccttccttctctccctcctcttttccttccttcttccctccttccctttctctctctctctctttctctctttccccctcccctcccttcccctcctctcccctctcctttcctgacacggtcttgctctgttgcccaggctggagcgcagtggtgcaatcacagcttactgcaggcttcacctcctgagctcaaacaatccttctgcctcagcctcccacgtaggtggaactacacccatgtaccaccatgcccacctaattttttaaacacctttttttttttttagacagagtctcactctgtccaccaggctggagtgcactggcgcgatctcggctcactgcaacctctggctcccgggttcaagcgattctcctgcctcagcctcccgagtagctgggattataggcgcccaccgccacgcccagctaattcttgtatttttagtagagatggggtttcaccatgttggtcaggctggtctcaaactcctgacttcgtgatctgcccgcctcggcctcccaaagtgctgggagtacaggggtgagccaccgcgcccagccttaaatactttttgtagagatggggtgtcgctatgttacctgagctggtctcaaactcctaggctcaagtgatcctcccgcctcagtctcccaaagtgcagggattgtaagcatcagccaccacgcctggcctcttctttgttttttaattaattagaagtccatggtttatttttttgttttgttttgtttgtttttctgtgatggagtcttgttcttgtcgcccaggctggagtgcagtggtgcgatttcagcttaccgcaaactccgcctcccgggttcaagcgattctcctgcctcagcctcacaagtagctgggattacaggcacccgccaccaagcccggctaaattttgtattttaagtagagacggggcttcaccatgttggtctcgaactcctgaccttgtgatccacccgcctcagcctcccaaagtgctgggatgacaggcgggagccactgtgccgggcctcaatttaattatttttaagtttaatggatttccagggagttatgccgagtcggaaaaaaaagaccactccagagcgtgacacacacagtgatttcattaatacaactgtcttgaaatggcaaaattttacaaatagaaaacagtctcctgggttgcagggatataagcaggagtgagagctgagagaggtgggtttggctgtaaa

SEQ ID NO: 1983 - DNA, 2050 bp, artificial
  synthetic oligo
gggacactctcccctcccccatccctaagggtctcgggtcactctcccatccctatccctagagttcctgagtcgctgggccctccggggttcagcccctccgtccccggtcccctgccccgcccaggcccaggccgtaccgcgttgctgaggatctcctgacggcgtggggaggcgctggccagcaccacgcgcttgtgcagcagcttcccaatcaccgggcacagcaccatggcgtccacgccgggagccgggcgtccgcacttctgagcccggagcccgcggtgcgcgcagcgcggctgcaaaaaaaacaggcggccagagtcccgcctccgcgaggccacgcccccgcccgcctccgcgaggccacgcccagtccgcgccttcagtggcctccccgcgagaccgcgcccaggccacgcctccattgaacactccgtcaggcctcgcccaggccacacctccattgccctctccaccaggccacgcccatgtcacgccccattgatctcccctgagaccacgcccagaccacgcctccattgccctctccgtcaggccacgcccaggccacacctccattgccctctccgccaggccacgcccatgtcacgccgccattgaccgctccgccaggccacgcccaggccacacctccttgccctctccgccaggccacgcccatgccacgccgccattgagctccccgtgaggccacgcccaggccacacccccgcccgcctcccccccgggcaccgccccggccgcttggtgaagcaccgcccccagctccgcctcccgggccccgtccccgcccccggcgctcgccccgcccctccccaccccgcctgcggcgccaagacctgcaatggcgcaggcagctgcggggtcccggggaggaaaggctggcgtggatacttggggttccttgcaggcgcggcgtggggagtggaaatgctgggtttccgcagctgcggttgtgggcagttgtgggggtggggggttcttacccgcacgtggaggggcccggcgcagagatgggggtcttgtgggagccgcgtcggggaaggtagagatagggggttccccgcggacccggtgcgagtggcgtggggatggggatgtcctcgtgcctggtgggaggggagtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatgggggtgtccacgggcctggtgggaggggcgtggagatggggatccccgcggggatggtgggaggggtttggagatgagggtccccgcgagaatgctcggaggggtatggatatgggggtccccgcgggccgggtgggaagggcggggagatgggtggggggggggtccccgcgtgcctggtgggaggggcgtggagaaggtgggggtccttgtgggaggggcgtggacactggggatccgcgcgggcgtggtgatgggcgcggcgtggggaccccctgggggcgcggtgctgggggcgcagggatgggaccagggcgggcgctgtgaggtgggggacgcccggctgtgccttccctccctaaacggagcccacctccagggcagcgggtcccttgcgcgccgcaggctgcagggggcgcgcgtgagctgtgcgaggatttttcttaaaccccagagcccagccgcacctgctccacataaacccagcgtggcgtggagactccgggcactgtttccccagcctttgtgactcaaaagattttaaaataaaatgtcaaaaataataatatacccagagcctatgccagtgatgtgtagatgcagaaaatggaatcctacagttaattttgttaactgtggaatgacatccgagggtgtccaacacattacggagaaaacgaaaaactgtagtcagagaagtcaca

SEQ ID NO: 1984 - DNA, 1450 bp, artificial
  synthetic oligo
agtgcaatggtgtgatctcggctctcggcaacctccgcttccccggttcaagcaattttcctgcctcagcctctggagtagctgggactacaggcatgcatcaccgcacccagctaatttttgtatttttagtagagacagggtttcaccatgttggccaggctggttgtgaactgctgacctcaggtgatccaccctcctcagtctcccaaagtgctgggactacagacgtgagccaccgcgcccagcccattttttttttttttttttttttgtaattttagtaacgacggggtttcatcatgttggccaggctggtctcaaactcctgacctctgatgtatgatccaccctcctcggcctcccaaagtgctgggattacaggcacgagccatcacacccagcccattttttttttttaataattttagtagcgacaagctttcatcatgttggccaggctggtctcaaactcctgacctcccatgatctgcccgcctcggcctcccaaagtgctgggatgacaggtgtgagccaccgcgcctggcgtgttcctgattcttggctattgtgcataaagctgctcttccctcattcccagccctgggaacccctttctaaagggttcagatgctgagtgcagtgatcactacagtcttgttccgggtggaccttacagggttgggatgagaaatagacaaaaggcatctcctcgtgggcagcagggattgcatgccggtgacagacccttttttgccagctattgtcttctggctataaccacccctctttcctgagtgctgggggctgtcccagctgttgaacacacaggggagtgagaggccccagccctaaggaaccacaagccagccccgtgcttgtcgtctgctctcctttctgttttctgggggtgtttgcaccacccagtttgtggttcttttgatagggctgcctcaggaggccctcaaccccaaagacagcaaatggcactctgttggagctgtggatttggaagacaaaacagacgctggcttcaattacctactttgattacgtagaaggaagttgtcgtgggccacaccctggctgatactctcggtattatggccatttcttacttagaaatagggtctgcgtctatgtcattagtgaagtcaaaatgtggtcataatagagtagggagaggccctaataaaattcactggcgtccttaggagaaagagaaatttaggcacagacacagagagaaggcatggaaagatgaagacagagacgagagtggatggatgggtagatggatgaataaatggatggatgggtgggtggatggatgggtagatgcatagatgggtggatgaatgggtacatgggtgggtggatggatggatgggtgggtgagtggatgagtgcatgggtgggcagatgggtgggtggatggatgggtggatgg

SEQ ID NO: 1985 - DNA, 1650 bp, artificial
  synthetic oligo
ccaggaggtggggtctgcagtgagctgagatcgtgccattgcactccagcctgggcaacagagtgaaacttagtctcaaaaagaaaacaaaaaaaaaaggccaggtgcggtggctcacgcctgtaatcccagcactttgggatgccaaggcgggcagatcacctgaggtcaggagttcgagaacagcctgacccacatggtgaaaccctgtctctactaaaaatacagcaattagtcaggcgtgctggcacacacctgtaatcccagctactcaggaggctgaggcaggagaatggcttgaacccaggaggcagaggttgcagtgagccgagatcgtgccattgcaccccagcctgggtgacagagcgaaacttagtctcaaaaagaaaagaaaaaaaaaaaaggccgggtgcagtggctcacgccataatcccagtactttcggaggtcgaggcaggtggatcacgagctcaggagttcgagaccaacctgaccaacatggcgaaaccctgtctcaactaaaaatacaacaattagtcgggcgtgctggcgcacacctgtaatcccagctactcaggaggctgaggcaggagaatggcttgaacccgggaggcagaggttacagtgagccaagatcgtgccattgcaccccagcctgggcaacagagagaaactcagtctcaaaaagaaaaaaaaaaaagggccgagtgcagtggctcacgcctgtaatcccagcactttgggaggtcgaggcaggtggatcacgagctcaggatttcaagaccatccagcctggtcaacatggtgaaaccccgtctctactaaaaatagaaaaattaaccagacatggtggcacgtgcctgtcatcccagctattcaggaggctgaggcaggagaatcccttgaacccgggaggcggaggttgcagtgatcccagatcgcgccattgtaccctagcctgggcagcaagagtgaaactctatctcacaaacacacacacacacaaaaaaaaaaagaaaaaaagattctgggcatggatggagatggggaacaggaaagaaagagaaagagaagaaaacacagcatgggtggggtccgaagaaccacccaaggctccatcgtcctgggacctttgagggatcatgtgggacccgcctcagagccatccctctgagacaagtgaaggatggacattgtgggctgagctggtttcctctgaacctggggcagcagaggagatggatgtgactgtggtcaccctggggttgttcggaggacgcaggtctcactgagcctctgggatccttgtcttatgagattaatttttacccatctgtgtgcaccatcaacctcttaatcttgcatgattgacggccaagcctattgcagcgaaaggctggtggctgtttgtggggtgagaagccgagtgtattttgggggtacgatgccttggggccgttcctggtgtgagtgaggcggtattggtcaccgacagttactgggctctgtgtgccaggtggatgcacagactttctgtcatcaaacatatgtgttacaagaacgctcggggccgcgtgcggcggctcacacctgtaatcccagcactttgggaggccgaggcaggcggatcacttaaggtcaggagttcga

SEQ ID NO: 1986 - DNA, 1000 bp, artificial
  synthetic oligo
ggctgcagtgagctatgattgcaccactgcactccagcctggatgacagagcaatactgagtctctttaaaaaataaacggcagggcgcggtggctcatgcctgtcatcccagcactttttggggtccaaggtgggcggatcacttgaggtcaggagttcaagaccagcctggccaacatggtgaaaccccgtctctactagaagtataaaaattagccaggcatgatggtgggcacctgtcatcccatttactcgggaggctgaggcaggagaattgcttgaacccggaggaggtagaggttgcagtgagccgagattatgccactgcactccagcctgggtgtcgcagtgagactctgtctcagaacaaaaaccaaaaaccagcatcatcgtgaaagggggtcgtgtgctgacgatattttgagatgtctgcagcagctctcgtgtgacttgaaaatatctgtggtttctctccgtcagcaagccaccggttttttttgtttgtttttttcctttttttttttcagacagagtttccctcttgtcgcccaggctggagcgcagtggcgctatctcggctcactgcaacctctgcctcccgggttcaagcgattctcctgcctcagcctcccgagtagctgggagtacaggcgcgttccaacacgcccagataattttgtatttttagtagagatggggtttctctatgttggtcaggctggtctcgaactcccaacctcaggtgatcctcctggcccccacactttcttctatcatggctgtggtttgccagtacgctcatggttgaagggaacaccacatcttaggaagaggtagtgaaaattagagtgaagtctcttctccttcctggtttgtagagcccgtgaattttacctctaggcccccaagggttaaaaatacctattccccagccactgatacgcagagcggcctccgcctacggggttcaagcgattctcctgcctcagcctcctgagt

SEQ ID NO: 1987 - DNA, 1200 bp, artificial
  synthetic oligo
cgagctcattttcaaacttttttgtagagaacgagtctccctatgttgccctggctggtctcagactccagtttcatgcagtcctcctgcctcggcctcccagagtgagtgatgggattacaggcatgagccactgcacccaggctgagcttgctttttgaatacaaatccccaaccccgagctcaccccttaagcacctcctctaccccatagggctgtcacactccaggccgtgatccacccaccctatctccctcctgtgactcagtggatcactcagaacagctcctggctggtagaaggccctttgcagagtgaggagcttctccaagtttattacttttagtcactgtgagcagggatagatagagttcaggatccccctgcctggggagcagcttgggaagaaaataatgaacaagcagaccgggcgcggtggctcactcctgtaatcccagcactttgggaggccgaggcgggtggatctcctgaggtcaggagttcgagatcagcctggtcaacatggtgaaatcccgtctctactaaaaatacaaaaaaaggctgggtgcggtggctcatgcctgtaatcccagcactttgggaggctgaggcgggcggatcccaaggtcaggagtttgagaccagcctgaccaacggggtgaaacccggtctctactaaaaatacaaaaacttagccaggcatgacagtaggtgcctgtcatcccaggtactcaggaggctgaggcaggagaatcgcttgtacccgggaagtgaaggttgcagtgagctgagatcgcgccactgcactccagcctggtgacagagtgagactccatctcaaaataaataaaaagactgactttctacagaaataatggacaaggagcatggggctggaagtctctgtggcccatgatggattttgtgtgcacgacttaccggggcctctgaatggggcttgttattacatccttctcttagctgttggccgcccttggctggacaggtgcgccggcttcaagaacacacagttaagtgcgtggccatatggaagtttggagcttgggtcagcccagccagaaagaccacctgaactcaggggcctgtagacaatcacgtcaccgtcaagattagacatggtggataaaaaaggatgagttcggccgggcgcggtggctcacgcctgtcatcccagcact

SEQ ID NO: 1988 - DNA, 1550 bp, artificial
  synthetic oligo
acggagtgaaaacaaaaacaacaaaacaaccaccaccaccaccacaacaaaaaacacccaggcacaaaagtgcaaaatggcacaatatcatttgcatgaagtgtctagaataagactgcttgcagagtcagagagcagatgggtgattgcttaaggctgagagcagggagactggggagtgacggtttaatgggtatggggtgtttttttttgggttacgaaggtgttctggaactagctagggccggtggttgtgtaaaatgctcagtgcactaaatcgtctcttcattgtgcaatttttaaaatggcaaactgtgtgtgatgggtattttcccacagtaagaaacagcagcagcacaaagggaggtgataactcacgtcatatcacaccctgcaggccccatcacccttcctccttcctctgttcacctcctcctccttttccgggctctgcagacgagcccgggcagccctccccgctggccgtctggacccaggcctgcctgtcttgggtgcattttaggacattaagtctggctggaacctgagagcatcagccatgcggtaagtccccacatccctccagcagtctgggaggggagctctctcctttgcttttgtacactctggagaaaattgtcaggcagcagacatgaagagcctctggggagattcagtgagggctggcaggcaggtgtccaggagcctgagtgactcacgagagaaaggacatattccttaaagacaaattcatcaacggattggtttaaataattcctgctcagcacatcccaaattaagcttcgtcatcagacactgcatctgttgccttttctagaaacatgagctctaagctcagtgacaccgtctgtcagggtttcaacgtttcacctcccccctccaggggagccggtttccatacaccaaagctctccaaggtccagttgtgaggatggggaacgctggctgtctggtgacggcctttccaaagctgccctgtcctcttgcattaagaaagattagtttgtactccgggaggagaggcgcagaaggttaacaagattagagagagctcctgagacctgcggtgagattccctgagggatgtggctaataaaactgtaaaaacaacgcaggcggtgtctctcaccgccgggtcctgatttcagggccgcaaatgtctacctcttctaggcagtttgctacctcaataatttaggttgtcagttgtggtatccaagccccagcacacttttttgtttgtttgtttgtttgtttgttttgcagtttgcaggtgatagtttctaaagatgtgtttttctatttttctttctttctttctttttttttttttttttgagacagaatctcactctgtcgcccaggctggagtgcagtggggcgatctcagctcactgcaagctccgcctcccgggttcacgccattctcctgcctcagcctcccgaatagctgggactacaggcgcccgccaccacgcccggctaattttttgtatttttagtagagacggggtttcactgtgttagcc

SEQ ID NO: 1989 - DNA, 1200 bp, artificial
  synthetic oligo
gccagaactggactaagacatgtcataagaaaaggagatgaggacacagacacacacagagggacaaccctgtgaggacacagggaaaagacggcgtctccaagcccaggagagagacctcaggaggaaccagccctgcccacaccttgatgtcagacttccagcctccaggactgtgggagagtcaacgtctgttgtttataagccacccagtctatggtattctgtgatagcagcctgaaatggactgagacagctcataagaagaggagatgaggagaaaacagacatgcacagagggacgaccctgtgaggacacagtgagaagacagcatctacaacccaaggagagaggcctcgggaggagcccgcccagcccacaccttcatcttggacttccagcctccaggacggtgggaaaatcagtgtctgttgtctaagctgcccagtctatgggacgtcaggctggcaaccccggcagatggagaccaagcccaggtgacttctctcctgactgggattggcgcaggctgctgtgtgcatatgtcaagaaagcctcttttccaggaaacaggcaattatacccacacttacctgctacctcaagagtcagggaggggagagacttcaggagcatgagcaattactcgagttcccctcccaagtcatttcaatctcctgttggttacctggctcattcagtctgccccacagctctattgcaaacagagccctctgtgttcatgggactgttcaagaacaccaagggttcctgccagcatttgtctctctaatgccacgttctgcaaagcagaccttggactggcccagccctttgtgatctttttccccaaagaaaacacaggcgcggtagctcacgcctgtcaccccagcactttgggaggccgaggcaggcggatcgcgaggtcaggagatcaagaccatcctggctaacacagtgaaaccccgtctctactaaaaaacacaaaaaattagccgggcatggtggcgagcgcctgtagtcccagctactcgggaggcaggagaatggcgtgaacccgggaggcggggcttgcagtgagccgagatggcgccactgcactccagcctgggcgacagagcgagatgccatctcaaaaaaaaaagaaagaaaaaaaagaaaacacccagaccatgggcacggtttctcgtgttagggca

SEQ ID NO: 1990 - DNA, 1100 bp, artificial
  synthetic oligo
tgagactccatctcaaagaaaaagaaagaaaacatgagaaaaatcccaataaaaggacttccgtcaaaaggcttgcccagtgcttttcaaagctgtccaggtcattcatctgaatcaagaaacgtctggaaaactgtcccagccaagagggaacccaggtagaagtaataactaaacaccctgtggaactgtggggcctgtgaaaggaaactaacccgggccccgacaagctgggaagtgcccagggcaaatcggcctctcattttattcaaggtcacccctctgcttactgagatagacgcatattctaattgcctcctttggagaggctaatcagaaactcaaaagaagcaaccatatgtttcccacctacctgtgacctggaagctccctctctgcttccagttgtccccgcctttctggaaggaaccaatggacttcttacatatattgattgatggctcatgtgtgcctaaaatgtataaaaccaagctgtgccccgaccacctagggcacatgtcatcaggaccccatgaggctgtgtcacaggtgcgcatccttaactttggcaaataaacttcctaaaatgattgacaattgtcttctaattttcttgactgacagaccctggatgggatcctaaacattagaaaaaaactaaagaaatctgaatagggtatgggctggttaatagtaatgtatcaagagtggttggttaattgccacaaatgcaccgtactaattgaagatgtttatgacgggggtataaaagagctccttgtggtatgtttgaaacttttctgcaaatctgaaatcattctgaaacaaaaaatgtaacttaaatcgacattaaatgtcaaattgcactctgttaaagaatcaagattaagattcaagttcctctcaataaactacagattaaaaacccctcaaagggccgggcacagtggttcatgccctgtaatcccagcactttgggaggctgaggcaggtggatcacctgaggtcaggagtttgagaccagcctggccaacaaggtgaaaccccatctctactaaaaatacaaaaattagccatgtgtggtggtgtgtacctgtagt

SEQ ID NO: 1991 - DNA, 1700 bp, artificial
  synthetic oligo
gttttttcattcaaagaggagaactctgtcctttccttcattctcccttttttagtagaaaaagtaattcttgtagaagatacgtattccttcagatctctcaaatttcctctctagtgacatctgcttcaccaacattccttttttccccttttccttgttcttgttcattttcctttatcgtctgtgtttttctcatacttaatttgcttcgtgatttaggaacttttgttttactgggatttgtcacttgaaagtcccaatcctttcacggtctatccaggcctttcaaccgtgccaataaccggctaagtctgcagtagtctggatggaattccagacggcgtccagtctttgtctctgcaagcctgcttctcattgactcttagatcggctctcctgttccagctgcaattttccacagtgcctctttgtttcagaattggagcagtaaccccttttctttttatttccagtcagctttttttcctgcccccaagtagcagagactgcagtgcacataaagttagggactcagcttgtgtctgcataaatatttgacctgaatctagacaagatgcaggtgcgtggtttttctgatttatttttacactcaggcaactcatcttttttgctgcttctaccctcgtgagaggtaagagctgggagtcacaccagattcaattcagccagtgtgctgctatccgtttcttttaggctgactctctctactgtttgacacagctgcctcgctagctcatggccatgtgtaaaatcagcattaagggggctgggtgtggtggctcacgcctataattcccgcagtttgggagaccgaggcaagcagatcacctgaggtcaggagttggagaccagcctggccaacatggcaaaaccccatcactacaaaaatacaaaaaattagctgggcatggtggtgcacgcctgcggacccagctactcgggaggctgatgcaggagaattgcttggacccgggaggcacaggttgcagttagccaaggtcacgcctttgcactccagcctgggcgacagactgagactctgtctcaaaaaacaaaaaacaaaaccaaaatcaacattaagggaaattgaacaatatattaattattgactgggctttcaggcaccattgtttaaaaagacttgctgaaaaacaaagcaagcttaccccatttcctctactccatccggagtcaactgtcacagctaagagttgtgatgatctccaaaaagtgttggatattggaagccttgatgttcgaactgcagagatttttctacagcagaagtggaagaaggttttctggtgaaggacagacttgaagatagctcaccatgattctcatattgtgatattcatttcttgcatgatcccctcccattgagtatggacaagacctgggacttgcttctttctttttttttgagacggagtttcgctctgtcacccagcctggagtgcagtgatgcaatctcagctcactgcaacctccgcctcccaggttcaagcgattctcctgcctcagcctcctgagtagctgggattacaggcacatgccaccacacccggctaatttttgtatatttagtagagacggggtttcatcatgttggtcaggctggtctcgaactcctgaccttgtgatcctcccactttggtctcgcaaagtgctgggat

SEQ ID NO: 1992 - DNA, 4600 bp, artificial
  synthetic oligo
ctccagcctgggcgacggagcaagactccatctcagaaaaaaaaaaaaaaaaaaagaaaagaaaagaaaaggaaaaaagaaagaaaagaaatacccaaatggtcaccatgatctaagcactcccttggagaactgatggatgtcagtgtgcactgatggacataaaacaggaccacagagaagagtcacacttgtagaaagaaatgccccccaatctctagccaaaagctccaagtgggagtctgtgtcacttccagtgacaactctgcactgactcactgcgtgaccttgggcaagaagcacttctacctgccttggtttgtggacctgaaacagggatgttagcaccaacctggcatcttcccaggacagtggcgcagatctggaggaacacctcacgggaaggtcttttgtagatcacacaggaggctacacagacatgagttactgtgatttccttttgtctaaaggtttctttctggttctagccttgtctatctgggggaaggagactatctgtgatggagatgagcgttcttttccaagagcgttaattagctgttcactttgtgacttcgtgagcgccctaccatttgaattctgaatccctgcgttttgttctcatttggtgatgagcctttcagcagacatggtagtgactattaagtaggcattttaatgcaatcgttcatagaatcaatatgtagacggctagtttctaatttatgagaaggcattctctgggaaattgaataaacagtgctcgattggaatatggaaattttatataagaaaaataatccgagagaggctgagaatgtacaagctctaaggaatcatcagatgtgaacaggacttcagctatcatgtttagggtgagcttcgttagtggctcacatctagtttcagctgcaactgtattttcatatcgttcccaggcaagccccgcgagtgactgactccacgaccctgtttcttcccaaaccctcacctgagaaacaggcttcttggattaaatcttccttttcctattcgactagcccggtgggtttgtgcttggcgtaactttgggccccctgggtgggatgtgcttgcgtgaagctccagtagcttttcctctgtgccgggaataatttgcaaagcgtcctattttggattttcataatcaagcttctaccccgtttcttttcagttaatttaatacctggagcacacgcagtacttcaaaaatattggtccgttctggtgtcagagagtctttttggactgagatgtaaaagtcctacatttgggtatgtgagctgggagttggggggccaggctgaggagaagcaacaaattccagagacaaacttggcatcttgggagatgtaatacacgcacccagccacagagtcccaggagaatgtattttaatggagaatgtggagggactttgcaaatgttttcattttctcaaatcatatctgttatcctgaaagtggtgtctgttccccctaacgcccccccgctccctccccaaccctttgcagacactggcatctgtggacatgagttaggtgctgcagtaccactcactgtgtcaactacagtattaactacggaaaacacacacacagtcacagtcacactgacactcacaccctaaccatcccaaatcagacatttgcagtcccacgggatttccaaagattccccggacaagcaatctatagattatcctgggaccagaaaaaaaaaagtcctaggatttttagtttccttaaccctcaagtggctggaaactgttaatcagagaggaatgaacataaataacaccaagccgagctccgtctgatccgaagtgagcccccaaacagcttctgtctgccctgattaccaaaggaagccatgcccacgcataaattggcagtctatttaaactgggtgttcttcctcacagttttttttttttcccagagaaatattcaaaggcaggcatttttctggctaagaagatatttatttaagtcacagattgcttcaccttcccaaacttgcccggcacacttggtgtagggcaaagcctcatccttgtcacatctgtccctctcccctctggagcaggggccagaggactttggaggacacctactccccccacccccaaggcttcggcttcccagggggggcttggcagtgtgagaaaggcaaaccgccttccgacctggttgaaattttgtttcccattgctccctagaggtgtcccttggccgtggataacgctcactctgttcctagcctcgcgctcaccgtgtttgtccatggaggttatagggaacttgagtgcggggtccccaccgccggagcagagggctagggacccgatagcgcctggtgtgccatagcgcattggacccacccgagagcccgcgttctgctgcaccggtggcggccacaggcgggagcgcctatgcgccttggacccaaggcgcccagggggtgggtgggacggacctggagggggtacagggggggcctgcgcccacctctctgcacgcgcatctgccgcttcccgtgccccataggggagccccgggctccgtgaatcctcgggttcagtcccgcgtccggattccgcgtcctccccgaagttggggctccccaaccgtggccccccaaagcgcccgcacgagcgcactcacccgctctccccggtgcgtccctgaaggtcaaggccaggaggcggtggaggtgcagggcgggcggtggggcccggagtagggggcgcgggcgccgagctggggggcaccgcgggacggctcagtccccatggccctggcgctgggggcgccccccgcctggcgaccccgggggtccgcggcgctcagatgccgtggtcacagtccacatcgcggcagatgtaccagaggatcacgtagaggatgaggaggatggcgaagatgaagagggccaccaggatcgccttggtcaccggcgagatgagagactgcatggccccagcggggcgcgcgggagggcggggggcgcgcgggggcgcggggcgcggcgctcacgacccccgagcgcgcccggagccccgcgccggccccgcgccgcatccgcaatgctccgtgcccgggacagacgctgcctgggtggctgctcggcggcggcggtggtggcagtggtggctgctcggaggccggcgcgctcgggtgcaggcggctgcgcgcggggctcccaccgcccgggtccccccagctgctggcgctcaccgggcccggcggccgctgggctgggctgggggcacggggggccctgggggcggccgggaggagggggcggcggccatgggggagagctggaggaaggcggcgcgccgggcaagtcccccgaaaacttggggcggaggcggcgcggtgacaggtggaaacgccagccccgcgggcagcagcgcgcagccgtccactggcggcggggggcgcgggggcgcgggagggaggcgcgggggcgagcgcgcggggaggggctgcggcactgggcggggggcctccctttgcagatggggagggtcgggggagagcaggcgtccccgactgcgcgcctttccatcacctctcccacctctctgcttttcccggccccctctctccagcgcagcggtggatatctctctcgtccaggtcttgcatctcaccccttctttgggagtccccttcctttcctcttttcctcactctcaccctgcaccccggtatgggtgagctgcgatattctcatcaaagaatgaaggtgctcatggagagaagctgccccttctctctttctctctctctctctgtgtctcttgtacagggaagggggtttcaagttgcaactaactcattgctgataccaagcaggatgggcccaggcaggaaaaaagtacacacccttgcccagagtcacagcttctataaggggaagggggagactgggttctgtgatgaaggggtgaggcagacgtcttggtgtgagactcagtcccgtgataaaggggcgatgcacacagacgccttagtgtaaggatccaggtttctgccctcgcatcacagaaagccctccaccccacgtttgtcccttactctctggggcttagccctggggaatggagagacaggcatggtggcacgtgggtgcacacacatttttcctgaagtgtgagctgtgtttagggctgatgtctggtggagacacgaacaggtcagggcacagcacagaaggccgaaggagcccaaattcttgggaaaggaggtagttcctccctagctgggcatcctgaatactctctttaagggagggagggagctggggctgttggacaggggcatagggcttgcaccaggaatccatgacatggtaagaacagggaccacccagtttcccagcaaatacacaattcaggcctttcatgccctgatttttgtctccgctccctgtggcccctaacaccggtgagcaggagctgttccacgatgcctggtagaagtcttcgcctgcctgcagtgacacactactgagggaaaattttatacctgcatgcagtgaccccagcaccgatgccccatggttctgggag

SEQ ID NO: 1993 - DNA, 3750 bp, artificial
  synthetic oligo
tctttcttgactctgagccaaactaaatgcaagcataagcttcatcaacaaagtagttgttcatatattatgcaacttccgtaatgccttttaatttcttctgaagactcaaccaatgctacaggtaagaaaattaaaaagacacacagacataggatcacacatcaagtttttgccaaattaaattattgttttgaaaataatttgcagcactgatgggcacacaccgtaaaatttccaatgtatgaactctgggctacaagacactctttatctttgcctgctgtgaacgctctgaggaaaattccggtggttttgaggcagtcacaaggcaatgtgctgcatacggcctggactcagaagcaaagggctcttgattttaatcccagcccaccgctgacaagctcaacggccccaggatgtttcctcatcagcagaggtgggctaatgaatccagatcccctgtttcacagttgttcctcaatgaatgaacacctagaaagttatacaacaatacaaaaatatcaggtagaaatttacttgtttgtaagtctgtcaatccatccatccactcacccttccatctattcatccatctatttttctagccacccgtccatccatctatccatgcacctatttatccatccatccagttatccatccatctatccacatatccatccacacacccacccatccatccattcatggatacaaccgttcatctacacatccacccacccacccattcaccaaactattcatctatccatccattcatggatacaaccattcatgtacacatccacccacccacccattcaccaaactattcatctatccatccatccatccctgcatacacccactcgtcgatccatccactcatccattcacccacccatctacccatccatctgtccatccatccatctacccacccacccatctacccattcatccatccatccatttattcatccatccatacattcagccacccatttactgaaaccttatctatcatccatccagccagccagccatttatatacccacccgttcatgcatccattcacccacgcacccatgtgtttatccatccattcattcatccacccacatatccacctacccattcatccaaccctccatctattcacccattcatccatccacccacccatccatccactcacccacccatttgtccatgcattcattcatccacccatttatttattcatctacccatttatctctcagtcaatccatgcatccagatgtctgtccatttatccacacatccacaacccccacccatccacccatgtgtacttccatcctcccactgactcaggaaacttcatttgagcatctgtacagccgacattgcgtgtggctcagacacctcttaactgccttggctgcccacaagtacctcacaggaggtctctgctataaattgggctcagcccctggcagtggagaccagaaataaaaagtgatttaaataacactgaaacaaacctgactttttaaatggtaagattaaaaacgtactcttctgtcctgtaatgaggtcaggagagttggtctgggcctggcacagctgtcttgcagtgtcaccagccaccctggcacctttgctccatatattctgccattcttggaataggacctctaccctctggaggacttcctgctctaagctagctgctggaactccagacatcacgtcattattccaggcaggcccagcatgatgcagagaaagcgaaaagtgggcttgttggccaccagtccccctcttaagggactcctcagaagtttcacccaataactttggtttacattgattttattaaccagaacatagatttttggttacacctaactgcaaaggagaatgaggatatcgtctttcagctgtcacattgccaaaatcagtaaattcaaggtctcttaatataagggaagaaagaaaggatataggataggcaactgtagtctcacacgtgcatgaggaatggatggaaggatggtggacaggagcgcgtatgtaaatactttttagtcttctcaggctgccataataaaatagcatagactgggtacttaaacaaaaggaatttattttctcacagctctggagactgggaagtccaagatcaaggggctggttggttcaattcctggtgagggctctcttcttggtttgctgtgttctcacatggaggagagacagagcaagcatgccctctggtatttcttcttacaaaggcactaactttcctgcatagggtcctaactttacgatttcatttaaccttaattatttccttgctgcaaatacagacacatggggaacagaacttcaacacacgaatttggggagtagatacaactctgctcatggcacatataagcatgcatactaaatgtgtgtgtgcatgtgggtcaatggaaagattggaagtctcattaatagcacatatatgcatgcatactatgtgtgtgtgcacgtgtgtctgtatggaaagataggaagcctcattatctaaatgcctagcctttcgggtgagctaatttttgttgtgtatgcattcaattgagtaattaagcttctcaaaggctgcctctctttgttgggctctctgcctggtgctgaggtacagacaaagatgtgactgctccacagcttatggggaggctcagataaacacgaataaatctaaataaacacacataaattaaggcctatttaaataaacacttgctgctctcagaagcagagccacggctgtttgattttactgctgtatcccacagagcagatactcaaaaagctttgttgaggctgggcatggtggctcctccctgtaatcctaggacttggggagggctgagactgggggatcgcttgaggtcaggagtttgagaccagcctgggcaatatagtgagaccctgtctctaaaataaaataacctgggcatggtggtgcagtcctgtggtcccagctactcaagaggctgaggtcagaggatcacttgagcccaggagtttgagaccagcctgggtaacatagaccccatctctaaaattataaaattagccggacatggtggcacattcctgtggtcccagaggctcgggaagctgagatggtaggatctcttgagtacaggagtttgagaccagcctgggcaacacagagagacctcatctctgcaaaaaataaaaataagcgaaaataaacacaatatttttaaaaacatgaaaaagctttgttgaataaccaggcatgttgagaaatcaccaagaatagagcactgtaggaacctggggagaaaaaagctgagttgttggtgcaggagccaagcagttaggggtacatgaaagaaaatcgctagtgggctgcaccctggcaaatgcagctggacgaaagatctgatgctactcattcccgaaggtcacattcttaagcttgaatgggtggcagagttgacctgactcagggtaatggtacaggaatatacatgtgcatatatatcatactgcaaatgtatccgttttgaatctgactctctaagaataatctacaggccaggtgcggtggctcccgtctgtaatcccagcactctgggaggccgaggagggtggatcacctgaggtcgggggttcgagaccagcctgaccaacatggagaaaccctgtctctactaaaaatacaaaattagctgggc

SEQ ID NO: 1994 - DNA, 1550 bp, artificial
  synthetic oligo
ggacttgggacgggggttgcctgtggagcgggggcctaggcttcctgagcagggagaggattgcactttgctccccttggggaactccctgaggtgagcagcggggaggggcccccatacttttcccagcaggggagccgggagtttcctctgctcccactgcagagcaggggagggtccctgctaggggcggagaaggggctgcaggggcgagtggggaggggggctacacgtttccaagaagggcggcagtttcgtgtcgctacagttgcaggcgtgcatttaggaggctgtagacagggagggacccgcactttcccgagcaggggagctgctgggaaagtttgtttttttgctcccactggagaccagggggtgaggggcggagaagtggctgcaggggcgagtggggagagggggctctatgtttccaagaagggcggcagttttgtgccactacagttaagggccgccctcgggcgtgcattcagagggctgtaaaccgggagggacccgcactttcccgagaacgttgtagttcactttgcttcgggtcggcgccgccctggctacggccctgtgggtgggtgagggggcgtgggcagtttcctgagaaggggcggggcgtgtaccgtactcccctcggcgctgcctgggccacccccgcccgcctaccccctctgtctcctccccgggcccggcgttcccgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcg

SEQ ID NO: 1995 - DNA, 3400 bp, artificial
  synthetic oligo
ctgcctcagcctcccgagtagctgggattacaggcatatacaagcacgctcagctaatttttgtatttttagtagagatggggtttcaccatgttggccaggctggctcaaactcctgacttcaagtgatctgccttcctcggcctcccaaagtgctgggatgacaggcatgagtcactgtacccggctgggaaatgaatttttaaaaaaaaaactttatgtatttctacttcttcattggaaagtcattcgtatttacttaagttttcaaatatcacagtgcagattagaacaaagtagttgtttataattcttccgcatcctccaagtgtatggagaagctcgcattcttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaagttctttcatggggagtttgtatcatggtcattttctagtatttagcattttcagcttttgtttcctgtcaactcaacattaaaagttttttaaaacgtccgggtgatattgttgctttgtttgctttcctggtttcattatccattttcaattttgctgctgtgaatttgcaccgtctccttggggagtgatttggctgtatattagtcagcgttctctagagggacataactaatggaatatatatatacacacaaaggggagtttattaaatattaactcacacgatcacaaggtcccacaataggccatctgcaggctgaggagcaaggagagccagtcccagtcccaaaactgaagaacttggagtccagtgtttgagggcaggaagcatccagcacgggacagagatgtaggctgggagggtaggccagtctctctttttgcatttttttgcctgctttatattctagccttgatggcagctgattagattatgcccacccagattaagggcggggggcctgcctttcccagcccactgactcacatggtaatctccttcggcaacaccctcacagacacacccaggatcaatactttgtgtcaatcaatccaatcaggttaacagtcagtatgaaccatcacaggcagtgtctacaagcaatgaaacatgcacacacctttctacctaattcctgcccattcctgaccaacgctcctaagaaaggaatagatttgatttttttcttgattttatatcttaaaaacctgttgtatccatgtctgtatgtgtgccagggtgaatcacaaagtcaggaagttagtgtgacgcagaataaggatatctttattcttttattttttattactttttattttgtttttgagacagagtcttactctgtcccccaggctggagtgcggtggcctgatctaagctcactacaacctccacctctccggttcaagtgattctcctgcctcagcctcccaagtagctgggattacaggcacatgccaccacacccggctaatttttgtatttgtagtagaaatgtggtttcaccatgttggccaggctggtctcaaactcctgacctcaggtgatccatccgcctcggcctcctaaagtgctgggatcgcaggtgtgagccatcatgcgtggcctagaatattcttatttccaattttacagcaacagaatgtcttctgtcttgtttctactttaaaaaaacagtttgctaaagctttctttgtagtgcagttgtgaattttcaggagcatcccatgaacattgaaaaggagatgcattcacgctttttaaggttatcgaggatgtgaaaattaaagtcggctttgtaaattctgccatgtctgtgagctcccagcatttgatcagctgaggcttcgagcggtgaagtagagtgcttttcccctaacgtgctctgatctggagcctgcgtgtattaccgctgggcacacggcctgccctgaccatactttagtgaagcagaggtgataaaactgggtttcccaggactcctgcaacacacagctttgatgtcggcaaactagaacccgggagccaaatctgcccacggtgtgtttttgtacagctttcgaggtaagaatttttttgtattattgtcgttatcgttgttttgagatggcgtcttactccgtcgcccaggctggagtccagtggcatgatctcggctcactgcaacctccgcccctgggttcaagcgattctcctgcctcagccacctgagcagctgggactacaggcatgcaccactacgcccggctactttttgtattttcagtagagacagggtttcaccatgttggccaggttggtctcgaactcctggcctcaagtgatctgcctgcctctggctctcaaagtcctgggattacagacatgagccacggtgcccagccaagaatggtttttacatgtctgaataattttcaaaactccaaagaacaataatattttgtgatgcatgaaaattatgtgacactcaagtttttatgttcataaagtccacttggcgcacagacattggttacatattgcagcagaatccatatggtttgcaaagataaatgcctttactatctgaccttctgcagaaaagcttgtctactcttgcctcaagaagcatgtaaaatacttacaacactggcacgttaggcatgctggaaatcgtagcaattattttgcaccttcactacatctgagaggatttcctgaacttaaccatttaacctaactcctcactaccttttgggaaacattttttttattaaggtgaaattcacaaatcatagaattaaccttttttttttttttgacccggagtctctgtcacccaggctggcgtgatctcatctcactgcaacctctgcttaccgggttcaggcaattctcgtgcctcagcctgccaagtagttgggattacaggcagtcaccaccacatctggctaatttttgtatttttagtagagatgggttgcatcatgttggccaggctggtcttgaactcctgaccttaggtgatccacccgcctcagcctcccaaagtgctgggatgacaggagaattcaccattttaaagtgaacaattcaggttgcttgctgctttcacagtgttttgtggccaccacttctacctagttccaagatattttcactgcccccaaaagaaatcccattagcagctgttttttatattggcttcctggggctgtcataaaaacatgcttca

SEQ ID NO: 1996 - DNA, 1150 bp, artificial
  synthetic oligo
tgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagatta

SEQ ID NO: 1997 - DNA, 2750 bp, artificial
  synthetic oligo
ccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgc

SEQ ID NO: 1998 - DNA, 1150 bp, artificial
  synthetic oligo
ctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtac

SEQ ID NO: 1999 - DNA, 1100 bp, artificial
  synthetic oligo
aaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctc

SEQ ID NO: 2000 - DNA, 1150 bp, artificial
  synthetic oligo
tttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgag

SEQ ID NO: 2001 - DNA, 2000 bp, artificial
  synthetic oligo
ttctgggtttatttactatccttatgtttttgtcttggaaaagccagagagtttttttgatgatatagagttgctgttaatcggggaggaagtttgggggaacctctgatcattcaataaacaggaagggactgcttatgaaatatattcaggcaaacagaaaaaaatggagtcactaaaaaatggaaaagctcgggtaaagctagattgcatcagctacttcatttagaatggcggtgatcattttcttcttgtcctggcaatgcctatgtcatctaacatttttgtcatctcttgaatggcgttcacttaaaaatagtgacacacatggaaagtaaatagggatacacaacaaacacgcgcctgcccattcgcccgggttctgaacgagcgcgaactgctgattaaaattctaaaacccaggccggactcggtggctcacgtctgtcatccaacactttgggaggccgaggcgggcggatcacctgaggtcaggagttcgagaccagcctgaccaacatggaaaaaccccgtctctactaaaaatacaaacaaacaaacaaacaaaacaaaattagctgggcgtggtggcgcatgcctataatctcagctgctcgggaggctgaggcaggagattcgcttgaatccgggaggcagaggttccggtgaaccgagatcgagccattgcaccccagcctgggcaacaagagcgaaactccgtctcaaaaaataaaaataaaattctaaaatccttcctataagagaggaacatcccaaacctgtagcttttcctgcctttaagtgacctagaaaaggttattctcttaagcccgggggcgcgtctcccttcagctgcccataaagaactgatggcgcacaggtagttttgcaaaaaagcaagtccgggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggccggcttccagagtccgctgggtcgcgtcgagctggctgcgggatgaattacgagctttcccggaacgcggctggggtggccctgcgagtccccgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcagagtgggcttcacttaggaattccgttggcagcttcctagaaacgcgggatggcggggttgaaggtctccagagagagccagggatggggagcgctttggggagagggaggaaaggaggcatgggatgtctgggcttaattagacctattcagtgcatcctccttcaagatccggctctcctccctatctgatccttagctacttaaaattgcaggaattcaggtatcctgatttcttagcaacttcaaacagtgctggggaacggtgcaatctgcctgcat

SEQ ID NO: 2002 - DNA, 1700 bp, artificial
  synthetic oligo
gattttctgctttgatgattttgactattccaagtattttcatgaaagagaagtacttttatctgaggaatttgagcactttcaaattattaggcccagaaatgtattaagacgagacagcaatcgtgtcctagtccccgctttgagctatgtatacatctattgaaactgcttgccattgtcacacataactataagttaacctaataataccacactggataccacaacccacaccctatggcttaacgagagacagccaatcacgaatcagtattatttctgtaaacagcaagaatttctgacaaacaattttgtatccactccccgtgaaatcgcttctctataaaaagtgtaaaaattagctgggcgtggtagcgtgcacctgtagtcccagctacttggggggctgaggcaggaggatcacatgagcctaggaggtcaaggctggagtgagccgtgttcatgccactgcactccagccggggcgacaaagtgagaccctgtctcaaacacatccacttgcaacggctgctaatcagagcgtctaagtgtatattcagggcaacttgaatctattcttccagtttgcaagcctcaagcttggctcaaataaactctctatttatattaattttgcctcagcttcttccttttaagttgacggcctcaaataagcagaaccacactctagttgtccttttgtgcctggcttatttcacttagcgtaacagcctcaagattcatctgcattatagcctgtgttagaatttccctccctttgaaggctgtatgattcaatcaataacaatttgaaacaaaagctttcaggcagggcttaatcttccaagaagaagacaattttaaatacatgggcaatttgaaagacactctaaaactagcaaggaagcactttatggtaaccgcaattgccaattaacttgatgttgaaatcacatagacaaagaaaaaggtgagtgaagagagggctagaatggctttgttcctcttaattgtcttattgtacactggaaaagttgcttggtttgcaaagacaggtgtttggaggaatctacagcgcttagaattacccccgggtgagctagctgtttcacgggaggatcttttgactcagcttggccatttttcaaatgtggaaaataatcagctctcagaaaggcagtttagagcagtgagtgctatggtttggctgttcgggaaaccagggtcctcttctgtctgcctcctgggtttctgatgtttccttggagtatcttcctgcttccccaggatctaaggaacagaaacatcagtcacagctctcatttcactgcaaatgtttttctctgcatgcgtctctactggaatacttaaaacccggcagacaggttttttttagagggttatgttgttgaatacagaaagaattgaatgcatctagctcggagacctctcaaaaaaaaaaaaaaaaaaaaaaagaaagaaaaagaagagaaaagactgggtgtggggctttagggaggcaaccggctccgcagagctacctggggagttttcagaacaaagcagatgcaatgtcgatggaatccaatctccccgtccttgcccttgcaggtccccagggggaggaggctttgggaaaaggcagacctcacgactcctctttcaaattgtccctttgaagacctgccttagatctg

SEQ ID NO: 2003 - DNA, 1250 bp, artificial
  synthetic oligo
gagcatttgatttctttggtaagacactttgtaccctttagctataaccaccttaacaccccctgcccccatccctaagcaaccacaaatctactttccatctttatagacttccttgttttgaattatcctttacatgggatcatacagaacacagcgttttatgactggcttccatcacttagcaaattgccttcaaggttcactcatgtggtggcctgtgtcagagcttcagtcctttttagggctgaagaatattccatgatatggatggaccacatttagtttacacattcatttgctgacaggccatttgaggttgttaccacctttaggctaccatgaataatgctgctgtgaatgtgtgtttgagagtttacgtgagcagacgtgagcacatgttttcatttctcttggagatatacttcggagtggaaacccaccatgttttagctgtgaaatattagacttgtcttaatgtctccaaacttttgtttccacatttataaaatacagtagtactttcctggtaggatttgggtggcaattatatgattgtagtttgcaaagaagttaagaagtggatggcacatcatgagtgcttcaacaatcacagctatggctattatttgtaaaaataaatttgcagaaagagaaagcctgtatagtgaaggggctagataaatgtttgaaagcacagaagagtttaccatggattcacattcctttgttgagggttgaatcatatgcccaactaacatatgttgaaagctgaacccccagtacctgtgaatggggccttatttggaaatccggtcttcacagatgtactgaaggatgtgtgtgaagtaagtgatgcagatgtaggttaaggatctcaagatgagctcatcctggattagggtgggccctgagtcccctgacaagtatccttttaagagacagaagaggagacaggcacagagaaggaggccacataagaaggcagggactggagtgatgtggcagcaagcccagggacaccgggagcccccaggagctggagaggcaggaaggatcctccacctgaggatcctaacccctttaaattcacagaacctgtgaatgggatctgatttggaaatagagtctttacagatactattcgttaaggattccaaaaggagcttatcctgggttagggagagtcctgcatccaatgacaggtgtccttctaacagatgaaagaggagacacagacacagaggaga

SEQ ID NO: 2004 - DNA, 1250 bp, artificial
  synthetic oligo
tgtaagaagtaccttttgccctctgccatgattatgggacttacccagccatgtggaactgtaagtcaaattaaacctcctggccaggcatggtggcttacacctgtaatctcaacactttgggagggtgaggtgggtggatcacctgaggtcaggagttccagaccagcctggccaacatggtgaagccccgtctctactaacagtacaaaaattagccaggagttggggcacgcacctgtaatcccagctactcaggaggctgaggcaggagaattacttcaacccgggaggcagaggttgcagtgagcctagatcgcgccactgcacttcagcctgggcgacaggagcaagactccgtctcagaaaaaaaagaaattcaacctccttttcttctaagtctagggtatgtctttatcagcagcgtaaaaacgactaatacagagagtaatgcataaagacacagaaagagggagagagacaaaaagagaaagagagagagagagagagagaatgtaataggagaaagggagggacaggagaaaaagagagggccctcttcccactatccttccaaaatcagggtttcctcatgaccccttcctcaaggcctaggtgccaaaaaggtcactgaaggaagcacagtcccctcttcctcagcaggcctgaaggctcctgggctatggctgctggtcttcctaagccagaagctataaccctgagccattgggcttcccagcctagcttcctcctgtccaaaatgagaggacaaacaggagttagagagcctgagaagacctgtcccagcaacacacccccctaagaaggcacaggctgaccactgacaactgtttaaatccagcgcccacgttcggctgggatattctgacccactcagggctgccccataaaccagcgcgtggtccggatccaagcgcaccgagaactcgaaacctctctgtcaagctgcccattgggagttaagttcaaagaggacaaaggaaacgagataaagcgtccaatacaagaattacccatttcagacgcacaagacgaagagcacaggcggtgtcaggacatgttaggatccgtccccaactccgccgtcttcatccccacaaagccacggaacacctgtaccccggagcccagctgctcctgcagcccctggagaaatctgtacattccccgccgaggaccctgccgctgggcacactgggaggctggcctgagggaccccgcgcccgtgt

SEQ ID NO: 2005 - DNA, 1100 bp, artificial
  synthetic oligo
ctaaaatacagtgatttaatgaagttcagtgataaacagttgacatatctctcatttgaaaatatgttaaaatgatgaataatttggtcaatgattattgatggagtgctgatactagaaaaccacatggttttgtacatttctattatcagccaagaatgacttaatttttcttttcttagtgaggtatatttggttagttggctacgcaacatctatatgcccatttttttccagctatcagaaatcctaaaagtgtgacagcaatgtgaaataaatcaagtgattaatcaatattgatccaatgcaatcatgacatttctcttcctgcttacccaacttctcctgggccatgtgacctgtacagccagtaatgtacatggtgtatccactggtgaagggagtggtgtggccatctgtcctccatctctctgcctgatgtgtagacaggaagcagaaaaacattctcatggagcctcttatcccctgccagaaccgacagaatttctttgcttgaccaaactgtggtcatgctcctaaaccttatcttaggtccttctgtgcacttccttataaaatccagttttagcaagaaccctgctaagccagtttagcaagaacgcttcactctccatatctgttcagacttctcatccccctccctcccccaggtgatgtttgatttcactggcctgtcttcagctaaaatcctgttaggtcagcttagccagaatccctgtcatccttggtgtctcctcttagtcattttccatccactgacctccgccctgctccccggctataaatccccacttgtccatgctatattgagagttgagcccaattcctctcccccactgcaagaccccattgccatagtccctgtatctatcccaatagcccagaataatgtctattttaccatgctttaacaggcataattaatatttcttttatttaacacggcataccatgttcaggcttctggttagctgagaaaattagcaccctgtatgtttaatccatctagagttagatgatagttgctgttttaggctgagctttatcctctccaaaattcacatgttgagacattaatc

SEQ ID NO: 2006 - DNA, 1200 bp, artificial
  synthetic oligo
ccttcctcattagatgtcacccccccccgcccccgacttcatccgccatgtcctgatggtgctttgtgacgtataaggccttccttcccgcccagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccga

SEQ ID NO: 2007 - DNA, 1500 bp, artificial
  synthetic oligo
ttctatgcagaaaatcttcatcataatgaaatcattagcttcaagaggaaaaagagttgtacttcaaacttgggaagcgagaagtgtctgatggcttgtcgaattacaagtttctattctacttgtggaaaaaaatattctgttaatgtgttttatgtgtcagatgaaaattgtatcacctagcacagcctgtcttacattctggaaattaatgttttagagcagggggattttttttcaacccagaacataatgtatgctttgacaaatgagctctcacttttgtcaataatattcaaagagtaagtagcaataggacagaggcagttctatccatgagagaacagccaggcatgctttattgcagagaaagaaagggaaaacagaataatattctgtacaagaaaattaagtttcaaaagattcaaatgtaatgtgtcaagaaactcttatttgcaagtggaatttaaaaggaaaccaaacgaaatgatggatgcatgtttcagcctcataagaggacattctcttctcctctttccttataaacagtatggatctgggcccactgctacaaccatcagacttccatcacagccagcatttgtgtttgaaagttctgtttcatcttccccacaccctgaccctccaaaaagttcagtaggaaatcatcctgggatcaggagagcatcaacagtcgctgttcctggtggttccagccactccccaccccctgtgcaaacaggctccagagctttgagttcttcattccccggggccctctctctccaccaaaacctcacagctttacatcccgtcccataaggaccaaatcccagctccgatataattagctccagccacagaatagtatgccgtaagttacacaaagatcatagctgtatacaaaccacatggaaatgtcttccgtacattttaaagatcttttccacatagcacagccttcttgcagatagtataatttacttatttgttattatcacatattgtctctccctctgctagcatgcagatccatggtcctgggggagctctgtatgctttatttgatgatctacctatcccacgccttcaagcagtgcctgggaatccctggcaacaggtgctccatgaatacgtgttcgatcaacatgctgagtgtgcttaaggctttccatttttactgtacagactttttagtagttttgtttataaccaacatatatttgtgcattcatagggaattctgactgttaagattttaaaaaggaaataagagaaataaaaagcctgctaatgacagtgagataatctattatcctctatcaatatgacaataagtgacaaagtgaaaatagtcgattcagatctcaaggacagaatgtaggattcccaggtcctgtctatgttcatacagaagatgtttggggtcaagcagagcctttgctcaactccacagaggtggcttcgcctggtgtgatcctctggagaagtctccgtttc

SEQ ID NO: 2008 - DNA, 1150 bp, artificial
  synthetic oligo
actctaccaaccaggctggagtgcagtggtgccatcgtagctcactgcagactccaactcctgggctcaagcaatctccccacctcagcttcgggagcagctgggactccgggctggtgccaccacacctggcaagggttggtttctattgagggttgggtgggagaatctgtcccgggcctctcttcttgcttctggcagcctcaggctatctttggcttgtagacatcttccccctgtgtgtccacttcgtcttccctctgtgtctgtctgtctctgtgtccaaatttcccctttttagagggacaccagtcatattggactagagcccaccctaatgacctcattttaacttgattacctctggaaagacactatttccaaataaagtcacattctaaggtcctgggggttaagatttcaacctatctttttcagggtaatgcaattgcacacatataatcactatatgcctctattctgtgtattctaagactcaaaaatagattatgctctaagctgcagtaagttcatgttggaagaagtcaaaggatgactctcctcaaggaacagatccattgatgatgaccaaaattcacatacatcatcattcgccattgaatgcatttgcaaagtaccccaggatctttccactggcagcctctccttcttgtagtgtttagaaatccacttcggggaaaaaaaaaaaaaaaatgctttttcctccccagtgagccagtctataaaagctctcaactaatttacatctgcaaaagtagatcacatcagacgctaccaggctttccatgcctccccactgggatttggcctcagcctcacacagctgtcttacaggtggcgcttgctgggccctgccaccccacgtcccctccagccatactatgctctttgcttgctttacctcaaatgtaccttgcctttccacggccctgagcctgtgttcaaactgctccctggccttgacatttttgactttttttctttacctattaaaatccttcaaagtcccgccaggcccagtggctcaagcctgtaagcccagcactttgggaggccgaggtgggcagatcacttgaggtcaggagtttgtgaccagcctgggcaacatggtgagaccctgtctctacta

SEQ ID NO: 2009 - DNA, 1450 bp, artificial
  synthetic oligo
ttctttgaggtattcagttcaatgaagaataatttaatttagaatcattaaaaagtgttagagctgaaagaatctttaaagagcatgaatgcaattaccttgtttttaaacggtgaacctaaagcttggacaagccgactgaattaccccagatcctgtctttatttcatttgtgtttccgttccctcattcagcacacaagacataaaccagtaaccacgccaagccagggtgatgttgagcctgcacaacctgtgccaccgccaggcagtgcaaagctaatgttagatccagacctcctgatttctggccaaagatgcacagaaaaaagcacaaaggcatctatgtccattgtcggagtcaaaagtctagcaataaagacagttttttttttcgttgttgaaacggagtctcgctctgtcgcccaggctggagtacagtggcgcgatctctgcccactgcaagctctgcctcctgggttcacgccattctcctgcctcagcctcctgagtagctgggaccacaagcacccgccaccactcccagctaattgtttttttgtatttttagtagagacgggttttcaccctgttagccaggatggtctccatctcctgacctcgtgatccgcccacctcggcctcccaaagtgctgggattacaggcgtgagccacgctgcagccagccaggagacactattaataccgaatggtgatgtctatggcaaaagcaccaacaccatagccatctccgcagcagcctaaatgattctgacagccatgggccagtccactgattccagaaacacttaatagtgagttccggaaaagaaaaagcaatgccccattttctttggatgtacagcatgcggcaaagcagtccactgtggagaccagagtacgtgatcaccaaagatggcttgactgagcctagcaagttgcgttagagggcttctgctgccattgtatgtcgcttcttgggcacttttctcatcttttttgacactgatctttaggaagaaagaggggaaattaggctaattgtggggaaaaaggaaaggtaaaaatggccaatggtcagagagacttgcaactgcccgaaaacaggcaagtaagcactcgtgttaaaatagagccacgatggtagagttagggatatcagcagataaaagccaaaagctaacagtaaaggagaaacacacatgaatgccttcatcacagaagctgctgatctctgcacatcaggagcttacaaactgaaagagttagagcagcatagacacacagaaagtggatgccaaaggaaacaactggcacactcatcccagctgggattcagggcctcactactcatcactggcacccgcattaaagacacaaaggaagaaactagaagaaatgaagctacaagatagccttcaccacaatcactaacacatggaatatgcgt

SEQ ID NO: 2010 - DNA, 1000 bp, artificial
  synthetic oligo
aaataaagttaagctaaaacagatcatcagagttaactttagtcataatcctggtcttaacaactatagaaagttttaaagacaaaattgtgatatggttgagactaccaagccatgaagctaaacttaggttgaaagcagaaggtcacattttccattgagtcattccctagaatcagacataaatatccccgacactctttgcactggacacaaaatggataagtcaagaatgtctccgacaattgattacactcactgcaagtttattttggaatgtgccacctcatataaggagttttccaattgtaaagacacctcggaatgatcaccaaaggtgtttgtttgtttcctgggtaccaccccgtagagagcttggttcaggagactagcatgggcccaggaattcgctcattccacaacctgtatcacactcctagtgtcaccaggagggaaccatgagctacagaggcagtaaccggcatgtgtaatcaatatgccagatggagttaaatttcatcaatgctatggctgcttttccattaattttgtcactaagattgtatttccttaaagtgacagccatttctatttatctgaagttaatggttttccctcgtcagcaaaggaactacatcagcatttctttttctttgcacttggtacaaaatagaatcccgtatccccagcatgaggcatttctaaagtccctctcactacagccatccatgtgtcttttgacaaatgaaggaatctcaaactcaaatacctagaagggaacagactttatatgcaatcacacaaccactttttttttttttttttttttttttttgagacagagtcttgttctgtcacccctggctggagtgcaacggtgcgatctcggctcactgcaacctccacctcccgggttcacaccattctcctgcctcagcctcccgagtagctgggattacaagcgtgtaccaccatgccccagttaatttttttttttttt

SEQ ID NO: 2011 - DNA, 1150 bp, artificial
  synthetic oligo
actgcctgtggtcacgaaaggtgcacctttacacaggcccgaccagcattcccagactccactgggggaagctgaaaactggttcagttttcccatccttctctttttttcttggttcttccttgctccctccttgaggactcagatctgggaaaatttcctgaagatccatatacacaagacgacattaaaaatgcctgactccttctagcttctagtgctgtatgggggctcacaccttccctgggagcatagaggagaatggagaactggggactctaagagaggcagatatattcacacttttgtgtaaagctttgtggctgaaatgactacttgccccagttcttccagcctctttctttcatagcagtaatggtgaatagggggtgattataccccccagggaacattcagcaatgtctggagatgtttttagctgtcatccctggaggaggagggttgctatcagcatctggtgacttgacgcctagtatgctgcgaaacccacaatgcctaggacagccccatagcaaagaatgatggaaccccaaatgtcaatagtgttgcggtggagaaatcctgctgtgccgccctctgtgggcaaggaccgcagaccaaaggctccgaaagaaactgagggaagccaaatgcatcagctcccatgggcgggttcttatgttttgtacatttgatgctttttctgggaaaagaaaaaaaataattatttctcagggtagaaaagattacggaaatgaaaaccacataatgacagagttatcttgtttagctggccaacaagaagccgtacagcaacagaaagctgccagctggtctgggaagccttagtaaggctgccaggtggtgagatgagtctcaatgactctgcccgggggtctgcacatctcactggcctggttgggcttgcaggaggcccggatggctacgcccttctgagaggtggggtgtgtgggcttaggccccagaactgggcaccaaagagaacgccgtgagctctccttctaggaggttctacgagaaggagggatgtcatcagtggggacatgagggagaagggctgccagaagacagaggacgcataggcccaccatgaatgaggttccagccaaaacctgtctacctaagtggc

SEQ ID NO: 2012 - DNA, 10500 bp, artificial
  synthetic oligo
ggacacaaggaactttgtgaatactattactccgttcaaaaaacctgttactgaagtaaaagaagttatctgaaacatcatgaataatctatgaccatacgaccctgaatatgatacaaaaagagaaagcattaaaatggcagaagagaagctaccagaaacgtcgtacataatctacggccatagcacagtgaacgctccaatctcatctggtcactgaagtacagagtacacgagattgcgcccagggtacggcctcttcagtacttggatgggaggaacttcgtgaaggctatcatttcactcaaactgaatattattgaagcagtcactatcccagccattcgactagaagcatccgtattgcccctttatgatatggtttaggctaatcaaaagacttggtttccaacaacctcttctacctctgagcagattccagacagctgatttaccattacgtttccgaaatcatgggacgaccagctgcaagcgagacgatgctcagtgggttgaaactgatcacacagaaggcatttggcaacggccttctctcccagctgtttgggtcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacacggaccacatcgggttccagctgagaagaacaccattgcttccatctgtccttatccattctcacagcctgaaacaagctcactggtagcttatgcttgcaagcaggactgggaacattcacgctatttattcgggagtactgactccagaaagtacagcaaccttggactgctcagcgccattggtagggtcttccgtggtgcacttggccttatttattttttacgacatttgacagaggacagagagagagcaagcattaaaacggcagaagctactggaaacgtcgtgagcaatctacagtcataccaccgtgaacgctcccaatcttgtctggtctctgaagtacagagtagatgcgattgggcccaggttggggcctgtttcattgttggatagaaggaacttcctgaatgctttgttccgcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcactgggttgaaactgatcacacaggaggcatttggcaacagccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggatccagctgagaagaacaccattgcttccggctgtccttcttcattctcacagcctgaaacaagctcactggtagcttatgcttgcaagcaggaccgggaacattcacgctatttattcgggagtactctggataaatcatcccattattttggaaatgtaatgctaggtcaggtatctggaatcttcctggaggtagaagagggtattggatggaaggaacttcgtgaatgcgatcattgaactccagaaagtacaccaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaacaagtcagccgcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagacgatgctcactgggttgaaactgatcactcaggaggcagttggcaacggccttctctcccagctgtttgagtcctggaccttcacttaggaaattggtggctcagatcaagaagcttgtctcatgtaatcgaatagtgctggaggaatccaaagccttggtgtgctgcaacatgaagaggcatctggaacaggccaacgagagaacatgtgaagtactgaagaaaatctggggttgtgcccaagggttggactccatgtgaaaggacttagaaaggaagatgaatgagtttccattgtcaggctgcacactgaccacatcgggttccggctgagaagaacaccattgcttccatctgtccttatccattctcacagcctgaaacaagctcactggtagcttatgcttgccagcaggactgggaacattcacgctatttattcgggagtactgactccagaaagtacagcaaccttggactgctcagcgccattggtacggtcttccgtggtgcacttggccttatttattttttacgacatttgacagagtgcagagagagagcaagcataaaaacggcagaagctactggaaacgtcctgaacaatctacagtcataccaccgtgaacgctcccaatattgtttggtctctgaagtacagagtagatgcgattgggcccaggttggggcctgtttcattgttggatagaaggaacttcctgaatgctttgttccgcttaagctgcgtattgttgaagcactcaatggcccagccattcgaccaggagcatccgtattgcctctttgtgttatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacaatgaccacatggggttccggctgagaagaacaccattgcttccacctgtccttatccattctcacagcctgagacaagctcactggtagcttatgcttgcaagcaggactaggaacattcacgctatttattcgggagtactgactccagaaaatacaggaagcttggactgctcggcgccattggtagggtcttccgtggtgcacttgggttatttattttttacgacatttgacagaggacagagagagagcaagcattcaaacggcagaagctactggaaacgtcgtgaacaatctatagtcataccaccgtgaacgctcccaatcttgtctggtctctgaagtacagagtagatgcgattgggcccaggttcgggcctgtttcattgttggatagaaggaacttcctgaatgctattgttcagcttaagctgcgtattgttgaagcactcaatggcccagccattcgaataggagcatccgtattgcctctttgtgatatggtttaggctaatgaaaatacttggtttccaacaccctcttctacctctgggcagattccagatagctgatctaccattacgtttccgaaatcatgggacgaccagctgcaagtgagacgatgctcagtgggttgaaactgatcacacagggggcatttggcaacggccttctctcccagctgtttggaacctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacatggggttccggctgagaagaacaccattgcttccaactgtccttatccattctcacagcctgagacaagctcactggtagcttatgcttccaagcaggactaggaacattcacgctatttattcgggagtactgactccagaaagtacaggaaggttggactactcggcgccattggtagggtcttccgtggtgcacttggccttatttattttttacgacatttgacagagggcagagagagagcaagcattaaaacggcagaagctactggaaacgtcgtgagcaatcaacagtcataccaccgtgaacgctcccaatcttgtctggtctctgaagtacagagtagatgcgattgggcccaggttcgggcctgtttcattgttggatagaaggaacttcctgaatgctttgttcagcttaagctgcgtattgttgaagcactcaatggcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagatgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttcgtgtgctgcaacatgaagagggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatggggttccggctgagaagaacaccattgcttccacctgtccttatccattctcacagcctgagacaagctcactggtagcttatgcttccaagcaggactaggaacattcacgctatttattcgggagtactgactccagaaagtacaggaagcttggactgctcggcgccattggtagggtcttccgtggtgtacttggccttatttattttttacgacatttgacagagggcagagagagagcaagcattaaaacggcagaagctactggaaacgtcgtgagcaatctacagtcataccaccgtgaacgctcccaatcttgtctggtctctgaagtacagagtagatgcgattgggcccaggttcgggcctgtttcattgttggatagaaggaactttctgaatgctttgttccgcttaagctgtgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggctttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggatttagaaaggaagatgaacgagtttcgagtgtcaggctgcacagtgaccacatcgggttccagctgagaagaacaccattccttccgggtgtccttatccattctcacagcctgaaacaagctcactggtagcttatgcttgtaagcaggaccgggaacattcacgctatttattcgggagtactctggataaatcgttccattatttcggaaatgtaatgctaggtcaggtatctggaatcttcctggaggtagaagagcgtattggatggaaggaacttcgtgaatgcgatcattgaactccagaaagtacaccaagcttgtactgctcggggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaaccagtcagccgcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagacggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatcgggttccggctgagaagaacaccattgcttccatctgtccttatccattctcacagcctgagacaagctcactggtagcttatgcttgcaagcaggactgggaacattcacgctatttattcgggagtactgactccagaaagtacagcaaccttggactgctcagcgccattggtacggtcttccgtggtgcacttggccttatttattttttacgacatttgacagaggacagagagagagcaagcattaaaacggcagaagctactggaaacgtcgtgaacaatctacagtcataccaccgtgaacgctcccaatcttgtctggtctctgaagtacagagtagatgcgattgggtccaggttcgggcctgtttcattgttggatagaaggaacttcctgaatgctattgttcagcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacacggggttccggctgagaagaacaccattgcttccacctgtccttatccattctcacagcctgagacaagctcactggtagcttatgcttccaagcaggactaggaacattcacgctatttattcgggagtactctggataaatcgtcccattatttcggaaatgtaatgctaggtcaggtatctggaatcttcctggaggtagaagagggtattggatggaaggaacttcatgaatgcgatcattgaactccagaaagtacaccaaccttgtactgctcagggccttaggtagggtcttctgtggtgcacttgaccttatttatgttttacaacgtttgtcagaggacagaaagagaacaagcattaaaagggcaaaagctaccagaaacatcgtgaacaacctacacccataccactgtgaacgctcccaatctcgtctggcctctgatgtacagagtagaggagattgggcccaggtaggggcctgtttcatagttggatggaaggaactttgtgaatgctatcatttaacttaagctgtctattactaaagcagtcaacagcccagccgttcgactaggagcacccatattgcctctttgtgatatggttttggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggttccagctgagaagaacaccattgcttccggctgtccttatccattctcacagcctgaaacaagctcactggtagcttatgcttgcaagcaggaccgagaacattcacgctatttattcgggagtactctggataaatcgtcccattatttcggaaatgtaatgctaggtcaggtatctggaatgttcctggaggtagaagagggtattggatggaaggaacttcgtgaatgcgatcattgaactccagaaagtacaacaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttgaatggaaggaactttgtgaatgctatcatttaacttaagctgtctattactaaaccagtcagctgcccagccattcgactaggagcatccgtattgcctctttgtgatatggtttaggctaatgaaaagacttggtttccaacaccctcttctacctctgagcagatcccagatagctgatctaccattacgtttccgaaatcatgggacgaccagctgcaagcgagacgatgctcagtgggttgaaactgatcactcaggaggcatttggcaacggccttctctcccagctgtttgagtcctggaccttcactcaggaaattggtggctcagatcaagaagcttgtctcatgtaatcgaatagtgctgaaggaatccaaagccttggtgtgctgcaacatgaagagggatctggaacaggccaacgagagaacatgtgaagtactgcagaaaatctggggct

SEQ ID NO: 2013 - DNA, 1000 bp, artificial
  synthetic oligo
agggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattag

SEQ ID NO: 2014 - DNA, 1100 bp, artificial
  synthetic oligo
ctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttggg

SEQ ID NO: 2015 - DNA, 1700 bp, artificial
  synthetic oligo
cacacacacacacacacacacacacacacacacagagcgagacagagagaagttaattgttagtctctccctggtgcagttgggcaaaaatgaggaaatcttttctggtctgggttttgcttaactgcgccatctgaagtttccatataacaaacacaataaacggattttttaaaacccaacgtcccttggatgggaattttaccgaccatgtgtttgcaaaactacctagtcggccgggcgcggtggcttacgcctgtaatcccagcactttgggaggccgaggcgggtggattacctgaggtcaggagttcgagagcagcctggccaacatggtgaaactccgtctctactaaaaatacaaaaattagtcgggcatggtggcgcgcgcctcccccagctactcgggaggctgaggcaagagaatcccttgaacccgggaggtggaggttgcagtgagccgagattgcgccactgcacttcagtctgggcgacagagcaagactccgtctcaaaaaaaaaaaaaaaaattacctagttgtcccatccggtccctagggaacagcctccgctttctcttttctctgtggttcaagtgttaagacggccagcccaacccgctagccgtgcgccatcacccgggcaccgatcaagttccaacccgagtggatcgagttccaacctgcgggccatgcgccctcacccgggcatcgatccggtctcaacctgcgggccacgcactctcacccggggattgagcaggtcccaaccccagggcctcacgccctcaccccagcactgagcaggtcccaacccgcgggcctcaagccctcagccggggaccgagcaggtcccaaccagccagctacgcgccctcagccctgcaccgggcaggttccaacccgcgggcctctcgtcctcactccatcacggaacaggtccaaatccacaggccgtgcgcccttatccgggcaccagtcgggtctcaacctgcgggccacgcgccctcacccaggcgctgatcagattccaacccgcgggccgcgcgcgcccttacccaggcagccgagaaggtcgcaggcagcggcagcgcgcaggatgcggaccgaggccggcggggacgtcgcgggggacccggggcccgcgggccggcggccgggcagcagctgcagaaggcccagcgccaagcggagcccgccgctgcccaggcagagcgcgtggaaggcccgcggctggaagctcagcacgagctgcgtggctgcgtcccgcgtggggcagcagaaggtccctaggcgcggggaggccatgggctgtgttcgcggacgcggctcgggtgtgccaggaccccgccggcctgcctgggtcatgtgctgggcgggctgggggcggcatcatgtgccctgggcctctcccccaccccaacccccagcgcctgcagtagagccaggctcggtgggggccgagagcactgggctaacgccacgaggcctcacgaggtgatgcttgggcgggcggaggaggaggacagagagagggagggctgagaggagaggaagagggaggaggaggagggaagtggaaggagaagcagaaaggttgggaaggttacctttctccccattcaccaagccttcctggtggtttctctgccacctagagcgccaaacctgccatctttactggtcttctagagaaacagg

SEQ ID NO: 2016 - DNA, 1500 bp, artificial
  synthetic oligo
ccccggggcgcgcgctcctcgaccccgaccccgaacccgctgaacggcgcgcgcgcctgagcgcccctcccggcccgctcccctccaccgggcgagagaaccggggcgcgcccctctccagctctccccggtacgagcggccgcgtgggcccctgagcgcgcacctgaccccgtccctcacccttcgggccgcgggctggacctctggacgcgctccccgtgaccggccccgcggtacgagctcccgaacgcgcccgccccgccccccgtcggccccgccccctccccgccagccccggccccggccccggccccggccccgccccctccccgccagccctccgggctccctccgccgccgggccggcactttctttccaagttacggcgcaagttctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaa

SEQ ID NO: 2017 - DNA, 1650 bp, artificial
  synthetic oligo
tgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattt

SEQ ID NO: 2018 - DNA, 3100 bp, artificial
  synthetic oligo
aaccatttgggctgggtgcggtggctcatatctgtaatcccagcactttgggaggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccaga

SEQ ID NO: 2019 - DNA, 1000 bp, artificial
  synthetic oligo
gtggacatagcataaattccttcaccaagccctgttgttggacttgacgttgttccccggtttccaatattacaagcaatgctgtgaggaccatctttgtggctacatatttgtggccgaccttattcatgtctttgcaccaatgcccagaagtggaactgccagtctgaaggtgtgtgcattttaaagctttcgggaaatatcgcggagcggccctgcacaaagtttgctcagactgcactcccaccagcagatctagagggtctagtgtctcctttctccaatacaacacctccctcttggcgctactcacccatgggaggctgtcccaggtcccagggtccccccgctcaccatgctctgtatttgtttgtagtttcctgggtgcgctgccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgt

SEQ ID NO: 2020 - DNA, 1100 bp, artificial
  synthetic oligo
cagaaatgaggtctcactattgcccaggctggtctcaaactcctgggctcaagcaatccttttgcctcggcctcccagagggctgggattacaggtgtgaggcaccacactcagccatgtatttcttttattagtgaggttgaacattttttgaaatgtttcaggtctttttttttttaatgttctctgtcagttatctatcgctgtgtaacaaattaacctagcacttaatggcttaaagcaacacccaattattatctcacagcttctatggatcaggagtttaggcacagcttctgcttcacattgtctcacatagctgcagtcaaaatgccaagctgctctgtggtctcatctgaaggctcagagggggagaatccactccattgcttgcacacattgttgctggcaggatttattcacttagttcctcgcaagcgatggaacagattcttgtttcttgccatacagggatctccacagaacttctcccagcatggcagctggcttcaccagagcagtaagagagatggccagagagagtgctggcaaggaggagagtactaacaagaaggaagggacagggtctcactgtgtcatgggtcactgcagcctcaatctcccagggctcaagcaatcctcccagctcagcctcccaaagagctgagactacaggcccatagaaccatgcccagctaattaaaaaaattttgtgtgtgtgtggagacagggtctcactttgttgtccatactggtcttgagctcctgggctcaagcaattctgcctcagcttcccaaagtgctgggattataggcataagccactacacctggcccgcagtcattttgtaacctaaccacagaagtcatctcccatcattcttgctgctttctattcattagaagtgagtggctaaaccagcctgcgctcgatgagaaggaatgaaggatgtgaatgtgaggaaggtgaagacctctgagggccatgtcacaagctgcctgctacaatacctactcatgtttctaacccattcctctattgagttgttggtatgcttgatttttaagagctcttaatatattatagagccctttgtgct

SEQ ID NO: 2021 - DNA, 1100 bp, artificial
  synthetic oligo
agcttcagcttccccagctgggagccagtgaaacagaagttcccgtctaggctgaaagttttaggagttgacccggcttcctccccagcaatggtctacttgggtctccgctcaaacgatcagaccccacaaaccggatgaagcgctcagggaaggtcaaggaactcccgcctagtgtgggcccccaggttagcccttctagggctgtcctggcggggacgcaaagtggccacctgcccagctgcccgcttccagaggcgtcctccctgcgccgcccgagaggaccggccgcgggctcccccagctcctcagctccctcggccccgccttcaggggcttttcccaccttcgcgggaccagacgggttgtgtgggagaccgagggcgcagcctcccgccaagtgcgcagagggtctccagacagccagagcccgggagcgggtgaagggagggcactgcccgctctctcgggaattgtttgcgcccgaggagtcaccccaggcaggccgcgcccgcagtccgggtagggcgtcgtcctccccgcccgccttcctctacgcgggggcccgggggcggactgacgcggcggcgcccatcctggcctccatgcggtttcccgaggccggaggaaggtggcggagcgggagggagagagcgaggagcgcgcggagagggaggacggcggagggggaggagcaagcggaggggtgggggtggggtcgaggagccgagcgccgaggaggaccccgagggagactgggggcggagcagccggcgacggagaggcgcggaggacgcggggccgggggaggcggagcagcgggagtgggtggaaaagcagaggcggcgggaggagcgggagcctccgtgggagattcgggaggagcagccggcgtgggtggagccgccggcgtgggaggagccgcggggcctgggtgagaacggggcgggacggccggaggcggggcctgcgaacgccctgcccctgctcgcccgggccgcgccgaggaacgaagatggccgggcgcgccgcgggaacggaggggcggccggcagcggcggcggcggcggcggcggctcccgggctgtgacttcgcgcgc

SEQ ID NO: 2022 - DNA, 1900 bp, artificial
  synthetic oligo
ctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcagggg

SEQ ID NO: 2023 - DNA, 1200 bp, artificial
  synthetic oligo
agaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatctaacagctctagttctgctaaaagcttaactagctaagggccttaaatccttgcattttaagagctccctaacagcattaaaacatttggaaggtgcaaaattatttcagccagaaaagttcaacactcaggacccaagggtatttttaaaaggatatcttgcactgaagccctacttttgcaaaag

SEQ ID NO: 2024 - DNA, 1000 bp, artificial
  synthetic oligo
gttattttgaaatatacagtaagttattgttaactattagcaccctattgtgctactgaacactagatcttattccttctatgtaactgtatttttgtacccattaaccatcctgtctttaatccccctcatctagaacatgaattctttgttgataaatttttgttttataaaatcatcattatcttactgctaagttaatatattcaaagtatgaaacatttttcactgagtctataccttctagatttcaaatacaaaaatgtaacgacattagttaattttaaaatatatattgtattttatataaacatatatatttttaagtttttaaaaatccacgtctgtttctaaatctgaacacatacactcatacaccatacacagtcttcttcctaccttttgagagtcactaccttctgaaaagaacctttcctaatgtaaattttcataagtaaagaacaaaatcaccattaatatcaaatggcaaagtttttatacatttccgatgcccaaattaaacctatttatgctaaagcaacaccaagtcacactaaaatgaacccaataatgtcaatatttatcataagttgttataacacaacataacaaggaaatagccctttaattcatcactaacatggttacctatctgcatatgttccgttctttcctagcagttatgtatcatgcatatcatgcacgtaagcctgtgaccataacatgtgcatttgaccatcaatgtttaagtaattgtacttttagttaaaaaataaaacaaatgaaactatcattgataacaatgcaaatgcactaagatcatcactattccaaaccagcaaaccaggagttctcttggaggaagagatggcaagaagcaccaactgcttcgtgcctgttccataaaacattggccatctattttctttgggccaaccaatgagcattcaaatgcccttccatctgtcctctaccaagtccagtcatcaggactgggtca

SEQ ID NO: 2025 - DNA, 1250 bp, artificial
  synthetic oligo
tatttcccagtgtgtaacacacttgagaaaatctcttctaaaccaagcacagcttccattcttttctccagcttgctctttatagaagagactcaaattaccttcccaaacaaacaaggctccaaggattacagctaacaacaaggataaaacaacaacaacaacaaaaataagactaaataggagagggagagaaacccaataaagaggtaaaatttaaaattaaacgtcaaattttataatttgatggttctatttatttctgattaagaaaagaaacctgatcatggaaagttataaattagaaaccaggaggcaagcaggcaggagaatagacaggaatgttgaaggtcacagcaggcaatgggtcataaatcaggagccaagagaacacaaacacctgagaggaggtcaaggtcaatggttctactctggacagctcatcaggaaccattaaaaagccataggagtgagatggctatagagtcttacccaaaagatgattgaaagattactaatttaggtttgattggcctgaattctcaacagccaatatgtttatgcatgttgtacatctaatggaacaccattaagatggctgacactgtcgatttatgcatttattgacataattctggcagactttttctaacaaaatgtttatatattttttgtttgttcatttgtttgttttttgagatggaatctcactctgtcaccaggctggagtgcagtggtgcgatcttggctcactgcaacctctgcctcctgggttcaagcagttctcctgcctcagcctcctgagtagctgggacaacaggtacgtgccacaacgccccccaaaaatatttttgtatttttagtagaaacggggtttcaccatgttggccaggatggtctcgatctcttaacctcgtgatccgcctgcctcggcctcccaaagtgctgggattataggcatgagctactgcacccggcccaaaatgtttataacaatatagaaatacattatatttctaactcatgcaaaggtgccttatgagcaagcaacaatcctgccccaaggtctgcctggtctctggaaggccatggaggtaatggcaggagggcagctcttgaaatcagatgacctgcattctatacccagcaccattgagcagttttcctcaccattttaggtttgagtgtcctcatcagcaaaatgaaatctatttctagatgatgtttcagttacatgaatatattagatt

SEQ ID NO: 2026 - DNA, 1150 bp, artificial
  synthetic oligo
gttaaagacaaattcctctaaatggcttggtaattaagaccacagtttttatggtaggtttcaattttactattactgaatttctaccagaatatgtattaccaaaacccattaatagaaatatatattactaaaccccatgaattttaagggcaacagtataagggaatatcagttctccttatatttcaaaggtttgactagcaagaataggctagagttgcactgaaggcttaagacaagagggagcggataattttgagagtgcaaatatctgaacaggctacaaaaggtagacgggaaatctcttcaaaaacctacaggaagattccccatttccagtagttttcaatctaacttggaggcggctaaactaaacatactgttagattccttttctgtactggggttctatagatgattaagcttttagcaagaagttactgcaatttagcactaaatcttccattacaggtagctcttacaaatgaatgggaatagtcaacaaaacaaacttaatctacatccataaagtcttacttctatgtatacgagattatgtgatcctatcatgtatatgtatccaactgtaattccaatttatacatgttattgatgatttgctactgagaagaagagagaagtgaggtggaaatgaccaggataagaagccaggacacaaaggttccaattctggctttgccctcaaagacgaggcagtattgtaaaagttacttcaaatgtatcggtgttttattttcttttaaatgggggaaaatgacgaaatcagattattttcaagtctctgtccaattataaataccatagtttctgaatttaaaaaaatcataatatatgtcataaatggcttcataattgtgagcatgtttacggaaaatatggggcagaattttttgaaaattgattgaatcccaagtaatcggtgcctatcattggctattctagtccaaggcacatgttctctctgtacatagaaaatgcatttacttctttatgaataattaataccatgaactttataatgtgctcacatcttgacaaagctatttatggaaaggtgactttgggcagatagtttgaactctttaaaactcagtttctttttgtgtaaaatttgagtataaacatt

SEQ ID NO: 2027 - DNA, 1200 bp, artificial
  synthetic oligo
atgtggaaataaaaacacacctggcttgaaatgagaagcacactgccatttaccagttaaagaacagggctcgactaagaacttttcagtttccaacattctaaatattctactaaaaagtgtctaaatgcaatgaagttaccatgtactggaatgaaggcagccccttggcctattggcatgtcttgggttacaccaaatccacaatacaagtctgacaaattcctgtgttccaagtcactaggccaaaatgcctggagtgacagcctgctgtcactccaatgcctaccatgaaaactataccttatttaacagctcgcaaaataaagttccacttgtttcctgctgttgtctcatgcagctgggcttaactcactgaccaaagtttctggcacacatagtaggtgcacgataactatttttgactaaagtaattctttagcttaggtcttacctttgttgcttcctagtgtgtgaccacatctctaatgttatttagccttgcactcctatgcatcttttagtacttcctacgtgctgggcactttccaggtaattatgacatgaaatcctcacaaaaactctttgaggtaggcactttcatcattctcatttgatagatgaagaaactaaggcaaaaaaggggcttaataatttgtttaatgtcacaaaacagagctgggatttaaacctaggcagtctggttcagagtctagctgaaccgattcacttcattttctctgcagctaaatctgcctacctctgaatctgagtctcagtgtcctcactcataaaatgaaggttgatactatcaccccacagagttgttctaagaacactaaactggcgtgcattctacaaatactaattgttattttgtttgtcaccatcatcatcatcctcacccatcaacgattatttgactgaaataagtgaacaagaaatcacctggaggttctaatttgagcagaattacactttgctcagaaagtctgctggcccagtccaggatttccctggacaaaattactagctatatcaaagcccttgttatattaaacgctgaggcagcatggctattgttgcctaaggcttctctttcccctactccatctatatctgggcctcaaagtaccagcttgcccaattgtttttcaaacccctgagagatgaagttatgagcaatacaagctgagaact

SEQ ID NO: 2028 - DNA, 2950 bp, artificial
  synthetic oligo
aatttgttagttttttgtaatctgcacccccaacacctaacagcctcagttactttgacacagtaactaacattaataatatgtgatgctaataattctgataaatgatgcttatttttctaaggcggtttactaaagccaaagtctaacagttatctcacattaacacagctgagtatgatctcagatgctattttcaaacggttttccttggttgtgtatttagcctaaatctccagcaattacatggtatttcatttcatttctgtaatgctaactgtactttaaaatattaaattacaactgatggaatctcccttcccttatggaaacagatccaaggcaaacctatagagtttgtggaccgaaggggataggggctgttcatttttaaaacaattactattctctgaaagtgtgttattttcaaagcgcccatcagtgacagtttcccaataggtcaattcactatttttcttaactggacagcaaatattttaagggtatctgatagctccctctgagtcccctatgtattgttgattcttcactaaactactaattgttctaaatggaatttaggcatcagcatatttccatgatctttcacacccctacacagagattttcttcttctcctaggttaaactaatactcagtaccatagatttctgaaattgccccttcagggaaagaaaaggtgaaaactagagaattcttgtcccccctgccacccaaacacacacacacactcactcatacagtcaatgacaccctccaaaataatgtttctgaattctctacagaacaagatggcagacatatttcaaaatatatttcatccaatcgttacaaacagcttagcaatagatatttgagttggaaaaaatatcaacattgggtgaagggataaggtgaccctttgaaattgcctgcagcactaacagaaaaccagaacaccatctctttctccagctcccacgactgctccaaagtagagccaacaagtcctacaagacgcacaagcgggtggccactagggacatcccatttccaggcaccatttagcaagtagaagaggaaaacccacaccacggaaaccccttagtgggtgccttgctctgtaaatgtaatggaattaaaggcggtctcctgaaactgcctgggggcctcctccttgggccgtgggacgcgcagcgctggtccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaaggg

SEQ ID NO: 2029 - DNA, 1100 bp, artificial
  synthetic oligo
atttattgagaatcctgagtctggtctaggaagtgaatgggtaaactatgtccaaatagtagtaggcatacagggttcacgacgactataaaaggccaagtagtgtttacacagccctttccatcaggaatgtgtgagaatgtagctaaatgtggatgggattgtgccatctgcccctttagtcaggcagtcaacagacacctggggacatgtacagctacaaggaaacagcactgcactagaccagaggaacatagatgactaacacaatttcttcccctagaaattcaccatatgccttcattcagctccagattctcttctttcattacctggatgtcatatggttctcttttccttgctaatccacattcaggctgattatgaaagtctatgtaaagacatttgctttcttttgtttgattcatgaatgctagagttctgtttcttggcctttagctcattaacattcagtttctaaagtacaagtgctttctttgcaaatttatgtttaattacatgatgactacatgaatgcattctcatttgtaagatagtcacccatacagcttcattaattcatctttgatattcttgcctcctgtacccactctgaggcttctccacagaggtaatgactgttctcagttattctgaactgttcagcatccctctaacaatgtctgttcgtatttgcaactcaccaaacacttggcttggctcattttatctatccatcaataccttctacaaaacgctttccctgactgtggttagagaatgacagcgcctctctggcatgaaagagcagaggactgggggcaaggggcactatctccagtaccaactgttccctcaaagattctcctttcctatagcctttagtgagcctgtcattttcacctctgcagattcccctgagcagctacaggccggagttacaagcttaccctggttgcagagttctgccttgctgcagttgggttgtttgaccatattgtcacagctacgctattttagggtaggctttagaaggatgatagtcagatgacatggagctaagctatactaggtgcccactttcaggagatggttgacta

SEQ ID NO: 2030 - DNA, 1050 bp, artificial
  synthetic oligo
tattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaac

SEQ ID NO: 2031 - DNA, 1750 bp, artificial
  synthetic oligo
tgctccctcctcaatcaagcttttcttggatttcaaaaccctgtggcaccctcatttctctgaatcttcattatgtctttgaccctggcatctgccaccacctctattactaatctgctattggtcactatgagaacatatgctcatctgtcaagagtttgcattctgattactcagctcccttccagggcaagaattctgcaattgcatgacttacaatattctaaagtgtattaaaatcatgaatacatttatcaaccctcatcaaattgtaaacttctcaaggataagaatattttgtcttttgggggaaagggatgagagccccaggccggctgagacggccggtccagggaagctccgccagtactgggcacactcaccgaacatggcttccagcagccgcgtctggacctggaacacctctggatctttcaggtcttcgggaactttcacccacggcagaatatttctacgtgccgggagcgttcccatattatgatcctcataaccaaaaccacgctccagcgcaagccaggcctaaccgcaccagctgagcctcagtgctggtaaagcctcgcacctggcggccccgcccccggccctggccaggaccctgagtctgcgcgccccgccgccctgtctgcggtccagctggttgccatctctgccgcttcccgcgacctcaagagagcctcacccgggcccagctgtctgcaggttaactagggtttccacctgcattgacctgtgtctttcgcaccagaatctcctgggcttgggaatggctgggggcggggcgctgttgactcttctagggaacaaccggtggggcctgaacctcagaaagcgggcgtccaggcttgagggtgcgaggaccacccagtagctgccgaatcgagttcctgcctcacacgttccaaaggagggtccgtatcccctcggccctaaggagcaggacccgcggctccactttgctggcaacctgggcaacgtcctgggaactctggaggaactcctgccattgaacaaagaggaaaccgaaattcggaaattgattatcttacatgaagggattagcgttcctcaaagccccttgaacctacccggattttaaagctcacctgtgccctgcctgggcactcgggccaaaaccggtccagccttctggctcgtctctaaataaatttggtttactcgttttttaaacatagtgtttggagcgatgcactggattcactagttgagagtgtgatttcactgttttatggctttacagatggtgatgaagctggcatttccagtcctggtaacatctaatatcccctcagctgtccattattgacggcttcttaaggcggacctcttcacacacacaaaacaactatgggttctattgcaaccaccagtgtagttaatttagaaaacgatcatcactgctaaaactatcagatgaagactgttgaggaactagatagtcacaaggtttggaagccctagcccacatattatgaattacaaaggaggaaaaaaaaagaacgttcctttacaatagagacttggaagaagccaccttaacccaagttagcatcaccaataatgggaaaaatggacttctgcttcgtcaatatctgaaaacaaaaagaggactgttttattacttgactaaagagactaaatgctgtgtgcatggttcaaataattctgaatcaaaggtgaggggttgcatttcaggaaaaggaaggaaatt

SEQ ID NO: 2032 - DNA, 3650 bp, artificial
  synthetic oligo
aagatcccgagtctggccaggtgcagtggctcatacctgtaaccccagcactttgggaggctgagaccggtggttcaaaaccaacctgaccaacatggtgaaaccccgtctctgctgaaaataccaaataataataacaaaaataaaattttttaaaaatcccgggtctgcctgtataccccgacaccatcaccaccggggatcacatagactactttttccttctctgcttctcttaggtgcctagaacatcggcactctttggggtttcaaacgttcacttctaacttggcttttgtttcttttttgagatggaatttcgctcttgttacccaggctggagtgcaaaggtgtgatctcgactcactgcaacctccgcctcctgggttcaagcgattctcctgcctcagcctctcaagtagctgggattacaggtgtgcgccgccacacccggctaattttgtatttttagtagagacggggtttcaccatgttggtaaggctgatggcaaactcctgacctcaattgatccacccgcctcagcctcctaaagtgctgagattacaggagggagccaccgtgcccggccctaacttggctttctaatgtaattcttttaaatccacttggtctttttaatcttgtgttagtatgtccggtttgattgtttctgtgttttttatcttcaagctggcccaaatccctttaggaagggaaataaaaaacacacaaattggaaaatatgtagttgcaactccaagcctatgagatctggtcaggacatgggtgccacagaaaccagaggtcgggagacccctgaaccctgcttcctgctcacggcaacagcaggggtggctgaagccagagagatagttttgctctcttatttcttatcacataggaatcacaggacataacgccatagcaattagcaggggcagtgtgtggagtagttcagttgacaggcttgaaagatcatacacacctaagttcaaatcccagctctgccacttagcagctatcgatcaacttgcttattctctctgcccttcagtttattcatctgtaacatggagatagtaattcacaccttttcagcttttgtaaggattaattgaattaatgaatgtgaatacttagcacagtgcttagggaatgaacaatatgggtgcaaaacatattagagccaaatataataagtatagttttataattttttcccagaagaaagctggataataatatatgactggccagtgggagggagagcatcaggatcaatagttaatgcatgcggggcttaatacctaggtgatggcttgataggtgcagcaaaccaccgtggcacacgtttacctatgtaacaaacctgcacattctgcacatgtatctcggaacctaaaataaaataaaataatatatatatatatacctatatatgactggctattttatcactcatctttctaaataataggcacaattcaaattgttctcttttattaaaaggtttggggctatggaaagaaaatcttgtagaaaacaccttatttctctcttcaaacgtttccccaatttttttcctttgatttttatatctttgaaatgtaattgccctcaaacactaatttattaacagttgaacatttgatttgcatacagtcatctttcattcaaaactactaaattgtttcggaagtttttttttccaaaaataaaaattaccaatacagattctcagcacgcactcaataaactgattgagaagaaatatactcttaaatttccttcacttttagaaagacaagttctctggaatttgctctatttcaaaaggttaaaatagtaagttctagttctttgcattctagatgctttgccatgagaccgatatacttcccatactttaatttttccaaaatataggaaaaatgtacaataggttggacgcagtggctcacacctgtaatcccagcacttcggaaggccaaggtgggtgaatggctttgagctcatgagtttgagaccagcctgggcaacatggtgaaatcccatctctacaaaaaaaatactaaaattagccaggtgaggtgacatgtgcctgtggttccagctactcgggaggctaaggctggagaatcacttgaacctgggagacagaggctgcagtgagctgagatcatgccaccacactccagtctgggtgacagagtgagaccctgtctcaaaaactaaaaataaaataagattttttttaatgcacaataaaaattagaataataccaaaacaatgatgatacaataaaagcctttctccagaagaaaatgaaaatataaacatatttctaaaataagtattatttgggaggttaagctaaaccagcaaatctcaagctacatatggttacaatttatatgaaaaagaaaatttccaaccaacggcatctgaaccataaatctagatttagacaattccactgttacttgttttcccagggctgcattattcattttagaattggaattttctttaattctctaaaatacaaggcaggaagcagattcgttgccatgtggaagagtgcaagtcctttgactacgtgggtctctgtccccgacctcaacgctgccggccatgctctgttgagcctagttcaggatcaagagcttcagaataccctccatcttaaggcaacatttatacagacctatttgatatgctctttggtttttttctcttcaacagtaaaagcacactccctcttcaggaggataattaaatttctccagtcccatgcacgtcctgagctgcattgcaggcccaggttaattggagacaggcagctatttgccctctaatttaaatgagtcctaaggctgagaggcatacaagcaaaatcagacacctacaagagccaacagaacaaacggaaaggtgtgcttagggcatggcctaacagcaaacacaagcacagtcgagaggataggacaatcgacatttggcttccatgggcagaaaatagagaccactggagcagacagcagagaggagaatgttgccccaggaaaagggggcagcctctacccaggggcagacaactatggctagatgtgcaggcaggatgtatgttgccagatcttctggtttttcaagagatgtcaaagatttggtgtttatatggagttttctatattttaaaagttaagaacccagccaggcacagtggctcacgcctgtaatccctgcactttgggaggctaagatgggcggatcacttgaggtcaagagtttgaaaccagcctggccaacgtggtgaaatactgcttctactaaaaatatcaaaaaaaaaaaaaaaaaaatagccgggtgtggtggtgcgtgactgtaatcctagctactcgggaggctgaggcaggagaactgcttgaacctgggaggcggaggttgcagtgagccgagattgcaccattgcactccagcctcggcgacacagtgagactccgtctaaaataaataaataagtaaatgtaaattaaggactggttcagactaaagacaacaacacaacattgctactcagaccaaagagaacagaactgcaagacgctggtttcctaattgtggcatagagtgatgttttcttcaggg

SEQ ID NO: 2033 - DNA, 1000 bp, artificial
  synthetic oligo
catggcacattaagattaaatgaaatttaaatttcatttctataaacaaagttttattggaacacaccacacccagtcatttacttgtgctaccactgaagacttgtgtagttgtaacaaagatcctatagctgacccacaaagctgcatgtatttgttctctggctagccctgtgctagactctgaggataaagctgtgtccaggactgatccaatccctgacctaacgttacttatgttctagtcaccaatggcaaagatattcaacatgcaattaaaggcagcaaattgatcattacagatgaggataaatactatgagggcaatcaacagacagagtaatgagaccaagaaaactgagctgggggttgggggaggacagagaattgttgtctagagggaggttaaagaagtgacctttataaactgagactaaaagattaaatgaaccggccgggcgcagtggctcacgcttgtaatctcagcactttgggaggccgaggcgggcggatcacgaagtcaggagatcgagaccatcctggctaacatggtgaaaccccgtctctactaaaaatacaaaaaattagacaggcatggtggtgggtgcctgtagtcccagctactcaggaggctgaggcaggagaatggcatgaacccgggaggcagaggttgcagtgagccgagatggcgccactgcattccagcctgggtgacagagcgagactccatctcaaaaaaaaaaaaaaaaaaaaaaaaagattaaatgaaccaagcctgtgatagaggagccattttgagctttctgagagagcaaggtgcatgtgcaaagttcccatggccagaaaggttctgtgcatcttagaaaggagaggagagaagctgaaggtcagtgggggaaggtgatatgaactcggaaagttaagcagggccagtttccaagtattatgggaggccattgacaggttttaaggagaatagtaattcattagctttgattaa

SEQ ID NO: 2034 - DNA, 1150 bp, artificial
  synthetic oligo
atcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtg

SEQ ID NO: 2035 - DNA, 1100 bp, artificial
  synthetic oligo
ctggtcacataggcacccaaaggaatctcctggtctgtgggttgcaaagactgtgggaaaagtatagtatctgggctggaatgcactgttcttcatggcacagtccctcatggcttcccttggctaggggagggagttccccgaccccttgcacttcccaggtgagatgacaccccaccctgcttctgctcaccctccgtgggctgcacctactatctaaccagtcccaaagagatgagctgggtacctctgttggaaatgcagaaatcccccaccttctgcattgatcttgctgggagctgcagaccggagctgttcctatttggccatcttcccagccacctggtaatttaactcttatgggccaaaatggcaaaagtcatctgtggtcaaatcacagagcccattacgtctgtcaaaggtcatggaattgataagattttggagttagatggaacattcatgactgaatgattcccatcttattttacagatgaggaaactaaggctcaaagagactaagtaactggcttagtaaggttacacagttccctagaggaaaagctgggggtagaaaatggggcttttcggccaggcgtggtggctcccgactataatcccagcactttgggaggttgaggtgggtggatcacttgaggtcaggagtttgagaccagcctggccaacatggtaaaaccccgtctctactaaaaatacaaaaattagccgggcatggtggcacacacatgtaattccagctactccagaggctgaggcaggagaatcatttgaaccagggaggcagagattgcagtgtgctgagattgagccagtgcactctagcctgggtgacagagagagactctgtctcaaaataaacaaacaaatgaacaacaacaacaacaacaaaaagaaaatgggggcttttctgttctttaagcagagatgtttgcattaacccaggcaacttcaatgattctaatcactagtgcataacagtgaaggagcttattaaacctcagggcagtgaggaaaagcaaaaaatacggtacggtaacttccatcagaacctgaaatacttgcatccactgatttggttg

SEQ ID NO: 2036 - DNA, 1200 bp, artificial
  synthetic oligo
acaactgtatttccttctagccctgcttgcagaatggctaacttcagtcctatttcatttctcttgtaagactgctaaaaacagtaagaagccaccaacatcattatgaatattgccaaatcatttcgcctaagagtaaagtcacagttggcatgtgttctgccctccaagacaagatagcataggtgacagttttatcagatatcttgtgatggcataatataggccacccagctttccagcctctgatatctgagtcttcccaatagcctgatgacatccgcatcacatattttaggttcgctcatggacagtaacttatttccaaattctatactggttaaaattaggtttgcatttgtgcaatagaaaatccaattgacattggcttagcataacaattttttgatttctcataaactcttggcagtcagcaggtccaagccattatttctgctctgctctctgaggtcatataaggaaggatctggatgctctgggtcatctacgtcatctaactggttgctgtgccatccctagctcatttttctcatgtgcattgcccaagatggctggctacaacatccacattacaagaagccaggtggaagcagacaggagaaagaggagaaaggggaactgccccaccgtttaaggacatgtcccagaaactgtacacctcacttcctcccaaatttcactggctatcacttagtcatatagccacacttagctgcaagtgtgtctgggagatataattatttttcacagtggtatatgcccaactacaaatggaggttctgtcattatgagatgagagaaaggcagaaaacatgttgagagatgtgtagcaatctctggactccacggggataaaaaagaattgagagtatcaaaattcaggatcaaaatcaaaattaaagataaaaaatatcaataactatcacctggaataagaacaacgtacagttcagctacacatatacaagtggcagcatcttgtctggaaggaactaatggtctttctacattgtattttagatatgtatttttttttctcccttccacaggattttgagctccttaagggcagagactttgtgtctcctgctcctagtaggcatccaacacgtatctgtcaactgaaagaatgaatatgagtcagtagatacatattagaattctaatatccactggctg

SEQ ID NO: 2037 - DNA, 1200 bp, artificial
  synthetic oligo
tatgaagtgttggagggtgctttgctcatttttttcgccatcgttgtggttagggtgcatgcactagtggaccccgggtgggggtggggctcccctccccaaaagcccggcaggcctccggatgccgttccgagacgcggcgcgaaggagttaagcgggccggcgggtgacatcacctcatttacataggagcgcccataaagctgcgcccgccgcaccccgcccgacaactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctt

SEQ ID NO: 2038 - DNA, 1050 bp, artificial
  synthetic oligo
actgctgccgattcaagctctctgaccccaaagactccccatcttgttactgggtaacatcatctacctgcaggaggcacttctccgatttccctctcccctgggaatgcccttgttctcttcctcttctgggtggtggctccatgctgctctttctggaaggtctcctgctgtgaagaacttcactcacgtatgctaaccaagcaccacccaaacaaagttcatttgtgctactgtcatttcgtggtcatgtcctttccttgatcagctctgaatcctctatctcaccacatatactctgccttttcattttgattttttttaacttaacaatatattctggggaagactccttcactcttttatacagctgcaaattactccactgcatttaaccagtccctcctgatgttcgcttggattatttctagtcttttgttattacaatgatgctgcaatgaatcaccttgcacattcatcattttgttcatgtacaggcagatctataggataaattcccggaagatggattgctgggtcaaagagtaaacaaacacatttgtatttttgaaaaacattggcaaatcattccttttagcaaccatgcatgagattgtctgttttcccatagcctcactatttaccagtctgttaggtaaaaataaacaaacttctagtcttggactccttacacagtaaagattgttaatataatatttgttaacatgcctatctctgccactgaattgtgacacccttaaagtctggaaccatttcttactcatcttcatagcctgttgcttagctagcaaagttctttggacagaatagcttctgccacttccctctctcccccgcaaaaacatatttactgagttgaatcaatcaccactttagcctagagaggcccccctcagaccttcccattgtggtatgtgctgccccactttcagctgactgccaatttcctctcgaggctgggcctgctcagcccacccacagagggaggagagcctgagattgaatgcaccaccgtcccagcagctctca

SEQ ID NO: 2039 - DNA, 1150 bp, artificial
  synthetic oligo
gcaaattgcttcaacgctccatgcctcagttttcccatctgcgcatcaaggacaataacagcactttgctcatagggtgtttacaatatataaatgagtatagagtgcttagcacagggcttggcatatggcaagcccttaataaatgttaagagttgatattgcaaaccaagctccctgccttgcttctctcttcaagacagagtccattcttcacatttccattttcaagccttctccctatggacaatatttggacttgtctaggtcctttctccaccatggccaccctcaggacatgataatgcctagaaacattcagtatggaggagccacagtctgggctactctgaaaaccctctgaagcacctgtcagtggcaggaaggagactctgttattcttcctgcagtgtctcagtttcctacgagtaactacttcttggtggacttgtattgttacatgcatgtgcacatgtgtgtacacacacacacttgcaaaggacagtgattctcagaaactggggagtctcaatccatgaagggacaattgaatctgccttggttctccttcccacgatggaaacaccaacatatattactgctgtatagaaggtgggttctctattcacatcgtcctgcttctaagaagaatattgctaggggcatcgtagtacacaagaagcaaagcctataatagcaccacttcaaacagcagggccatttacctttaatttctacttttagaaatgaagtatacaaaggcttggcacaagatcagaatcagacactattctttaccttggaccagaaaaaattctaaggcagggttaccacccccttctagtttctgaaatggaaaggaaaaagcatagagatgtattttcccttgtccgcagcaaagagcaggggtggctcttccaactgtatttgttcaacacatgttaattgggcacctataatatgtaagtggtggacactgaatggaaatccaaaaaacataaatctggtcttgtctttaaacagacggtaatctagtcagaggcaggggaatgcttcagaaggacaggcggagaaaaagaggtggtgccctgatcactactttacaccaccaagtgcttggtccttggtagcaaagtttaaactatggttt

SEQ ID NO: 2040 - DNA, 1300 bp, artificial
  synthetic oligo
gtgggtgcagggaaagaagcggcaccaggcaggtgggaacactgaaagcaggtactatataaagtctcatctgagtagccaagcagtagcaatagtgtggtgtctgatgccagctaaatacaatgccacataactaccttttcagtgcaaaaaatcatttctatcctctgaaatgcttgttgccatcagatgtcatgagaacaaactgacacgataatatttaaagccaatagtaaaagatagatttcaagggaaaacatatggactgaatttgctcaatgcccgactgtaagcaaaggaaaacaaaaacatgcacatttcacattgtcaaggaaaaggcagaagcatatctttactcaaaataaacatcgccagcaggtgcaaaacatacatacgtttactctccacacttgctgatgcgactgccaagtaaacatgcatgtaagcttgtagctgaggatggcaaacagaagcatacatctgtcaagagaacagacttcactcgtcttcactgggtggttcacttccgagggggctcttcttctagccgctactgagtcagggtccatgtctacacaagggtttaaaacaggcttattttctatatattttaggagactggaccaccccattttaatggccagactgaatgcattcagttataccaggctaattatcatcccactctggacattgtaatagactatgaatgtcacatcgcaaatgaatgtcacatctcaaatcctgcctctaatttcctttttctctttgtctccaatgacctcttctactccatattggccacatggtcacatcctaaactttacccttcatctgaaagaacacctattgtcatctgtgaaatcacaaattcaaatatctggcactctgactacatatttcctctccaatactttggttctcccaatactttggttctcctgcctcaacaggcccattggtccctaaacttcctccctcccagacactctcttcctttcttcacttcctttcctatccagctcagataacttggacctacatttcaaccattcttctgccaaggtcttcattccccttgcctattgtccagctctccaatcaatttgtcaaaaccccatcctcagtgggtccaactgtctgcctcttctaatgctactcagcagaattagaaaaaaactatacaatctctcagatttgcactacaacaaatttataggatccaaaatcagttgggtcttcaatgttgctacaatctttgtgtttcctttgtcaaatcttcgtcccattttccatatca

SEQ ID NO: 2041 - DNA, 1850 bp, artificial
  synthetic oligo
gtggacgtaggaaggacagaaagggatcagtcattcattctaatgtaacacgttgtcagaacaaagaatgtgtcagtacccaaatggatctgaattcatatagcattcatgtttctgccatgaatttctgcactggttactatattgggatgtcatctggggtcccatgtaagtaagctgttgcaaatgggcctgagagattacttgccaaatgacagggttgcccaggacttagtgaccttccagctctagcatcccattatttgcagtttgtagaagaaaaccgggagaacgtgaaaacccaaagagaagtgagggatcatgtcttaggaacctgcatccttccatcctgcttcgacttctcaactaaattcttaagtcctggagtgcaggtatcaccgaaatttgccccatgcctgaaatacatggtagtagatggtgactctgacaagcgtgaagtgacctgaatctgggggaagtttctgggtgaacagagagcgcggaggatgcgcgggtcatgctggaggcgggtcccagccagatgtgcacagcccgccccgccctccctcgctcaccccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatcggcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccagggcactagggcagc

SEQ ID NO: 2042 - DNA, 1950 bp, artificial
  synthetic oligo
acattctgcggtgaggaccctgaggctccaaaagggaatgtaacttaatttgctcagaatctggaagggtagtgaatggcagagcagtcaattgacaaagagttataaggtagttacagttctagagcttcctgatcgactgagtggtggggggagccccgctcaagtgccaacaagaagcactcattccactaacacagtcaaaagagaggacagcagtgaagctgcagctctgtgaagaaaagcaacagtcaggtcgtctccagcctcacagttctggggtttcaatacgtctgctgctgtggcaaccaacggctttccccaagccctggacctccggggcaactgggagaatctgatacagcaattatgccgtcgccaggttcaaacaaatagcaaggtgattgttttggaaaggtcacaggtattttggtccataattcagtgaagaacaaagtcaccaagagccactcaagtgggtctactcaagtttcattcaagttgacatcagaaattatctcaaatttttaataaaaatgcttccccccagcccagtcagcccaagcaattcattcacagtcctcctcctccccggcttccacctgcccccttccccgacacacacgttcagagtcagaacccagaactggtgggtgatatttaagtacttgaaggagaaaaaagaacagaagaaaaaaacaaaaccaaaatgaacatccatgaagtggaatgaaggagagacagccgtaagtcactcttaatcttgaaaagacgagacttgtattcatttttaaaataaacttttacttgagatgtccataaagacctgcctcaggggcagagccaggtgacgttttcagtttggagacatttacgtttcagtaaaggcagcactggcctcaggataatgtcagtacctctcctaacctcctgtctctgtttatattatccagacccttaagtaaatggcttgtcggggaaattgaactttaaacgcattatggtgtttagcagcaatcaagggcacttcattactttagggcaagcacattaagccagcaaaaaaaaaaaaaaaaaaaaaaaaaaaatcccccaaatggtcttcatagttgtcatggaatgacaacccagcataaaacaccatagatgaatgttttcattttagtgagcattccttttaaactagcattcgcttaaacctatggaaagtgactatgaaaactcattactagatttctctttagttcattagaaaataaaaaatatcagggcttcataagaaagctgtgcttcctttaatttcaaaagatgagcagctgtttttaggaagaccaacttccctgaagtggattggggaaactatataaaatgggaaccatcctggctaacacagtaaaaccccgtctctactaaaaatacaaaaaattagccgggtgtggtggtgggcacctgtagtcccagctacttgggaggctgaggcaagggaatcgcttgaacccaggaggaagaggttgcggtgagccgagattgcgccactgaacttccagcctgggcgacagagcaagactccgtctcaaaaaaagaaaaagggaaccagtgcacaatatggttcaagttcactagcaagtcagtatcttaaagagcttcagacacttgggatttgtgagcagagatgttagagctcaatcttattttgtcacatgactttctggggactgaggtgagaggaatgcaactcaaagtccaaattctctccaggttcccaaactaagagaaactagaatccttggccttgacgtatctcattataaagagaaaacagacatgggtattgtatcatccacaacctccccacattctcagcctctatgatcatgttaagaaaaagatgaatgcctgctttcctggctaacaaagttgtatctggttcttaaaggataaagatgtgag

SEQ ID NO: 2043 - DNA, 1800 bp, artificial
  synthetic oligo
attagagccactgcggttacagaatatgtttttgggcatttatgacagtctatgactttgagtgagggaaaattacaatgcagtgagatccattaacctaacagtggctgagccgattctatgggacatcaaacttgaaatcagtcattatttagaaaaaagagattaattttagttcctttctgccattttcttactgcaaaaacactttattctccaaaaaaccattctgtatatgaaaattgtggtacgttctaagattctctttaagaaataggacctttatcaattttcttccccccagtctccaagtcataattagcagaagatcccccgccctgcctttccatcagcactgggtgacagagctgatgtcccctctctgaagctccaactgtaaatgattattacatgtcgtagtcagggcctgatacaagaaagagcaatcatattagaataagaaaattagagaatgcccaaatcactacagcattagcggaaccaaagcagaattaacatgcatgcccctccagttcctcctcagcattagcagaaaactacacattccacgttcctggaatataacatgcaggacacaagacctaagttacgattaattatattaataaaaaaagacagtttccccaatgcatcagcccaaggtgacaaactatagacatccctctatgaaatatcacgtcggtagaaagatttggaacaggaatggattgaagaaaggctgctctattaacttaacatcagcccacaggaaaaaaatcaaccctgaaagcaagaccatgccatagggattgtctcagagccattttaaaagagagacaaaacccagctaaccctttttaagcaccccccagtgaaaagctttaaacaggctattgtcagagcgctgggtaccttttctctcttggctttgttcagtattttcctcggctgcagtttccatggctggcttcataccatccaccaaaaatgcttttccccctgttccccccaacacacacttgtttttcctcctcttccttttcttttggactcccctccgtctcttatttacacccgtctgattgagaggctctgttcttcactacagtagattacagtcccttccaagatgcaaaagtcttgtcagcgtcaatttcgctctgcctactggtccataaagacagctgccaaggggcaggcagccatacgtcaccgaggatcccagttagaaaacagccattcggcgcccggtggtgcctacagtctcaatgcggctccagtgggagttgggggtaggggggtgggggagaaggacctgctccccaccgggctcttcctccttgctctctttcttaagatctcaatctcgatctctctctctctctctctttctccccacctcatttcttctagccaagtacacccaatgaatgctaattaattctcccaggaaaaaatagatttgtgacatcagaggaggggatgtgaaggagaaagaaaagagccccctcccaccacgtgactttgttggtcgacagcaatatatgtcgtctctaaggagaatgcatgtctttgcataggcatgacactttctttcctgtgtggtccatttatgatgtatcagtttatttcatttacccctcgaccctggcaaaacatattcaaaggacgtgcccatagtctctatttactttcttaaatatttgtctttcatacaatttctagataagtacattgctttttaaaaatataaattaaagagggggagaaaatacattagagggaagaaaactcaaacac

SEQ ID NO: 2044 - DNA, 1400 bp, artificial
  synthetic oligo
gcctgccttttgtttatgaagaccagagcatggccatttgactcatcagtggcaattttcagcttctgtgagggattctttgctcttgcttcgcaaagaacacaacaatccttttgctaacacacggattcttctaggaatgtgcgagcatgtgcatggttatgtcatagtctgaaatggcaggccacgttagcgtaaaggtctctctactctcctatacaagcagaaaatgatctctttcacaacacaaggccagtgatggggttgttgtagaggaatcagctatgctcaaagcaggggacagagagctatgtccaatcttacattcttgaaagcagatagtagtggtcgtctctctcctgctcccattaaatctcctgaagccagagtgaccatttaaaaaggcaaatcaggccgggcgcggtggctcacgcctgtaatcccagcactttgggaggccgaggcgggcgggtcaccaggtcaggagattgagaccatccctggctaacatggtgaaaccccgtctctactaaaaatacaaaaaattagccgggcgtggtggtgggcacctgtagttccagctactcgggaggctgaggcgggagaatggtgtgaacccgggaggcagagcttgcagtgagccaagattgtgccactgcactccagcctgggagacagagcaaggctccatctcaaaaaaaaaaaaaaaaggcaaatcaggttctattacttccctgccttaaacctttcgaggctcttagaataaaatttcaaactctttatcaagctctgcaaggcctttgaggttccagcccctgcctgcttattgacctcatctccaatctttacccccttcttacactccaaacacaggagccagctttcaggtgttcaaatacgttacaccggtttctccatggggcctttgcaacctgccgttccctgggcttgatgctctgccccaaatttgcaccaagtcatgcatgtcttggctcaaacatcacctccagcttctcatggtcatgttaacctgttctagagactctctgaacactctgctcacactctggaaataccttgttcatttgcctgttctcctgtcttgtttattgcctatttcccatccctaaaatgtaagatgtgagaacaggaatcttgtctaccttgcccaccactataggcccagcaactgaaacaggcaactgaaacactaagtggagcatagagagtgtgaaagtgaaatacagaactgggcacgtggctcacgcctgtaatcccaacattttggaaggccaaggtgggaggactgctttagcccaggagctcgagaccagcctgggcaacacagcgagaccccatctctacaaaatatttttaaaaaatagcgtggcatggtggcg

SEQ ID NO: 2045 - DNA, 1250 bp, artificial
  synthetic oligo
atgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggac

SEQ ID NO: 2046 - DNA, 1150 bp, artificial
  synthetic oligo
taagtgacacttgatacagtgaactgtttctaagagtgtcctttatagaaatacaaacaatcctacttcaagggaaatagatgttcatttcaaaattgtgctttaaatatttatgaaaccgatatgttctgttttatcaggttgtgatacaaaataatttgtcatgacttctttatttgtactaacttactcccagctgtgatgcctcctatttacaagaatgtcttccttccatccctacagtcctcacttgactatgattctaagaactttagttttgctcatttggtccaagggtctaagttctgacttttattaccttgagcaaaaccctggaaatactgtgcttttattgttgtcttggcccaagactcttctattgctgctgtttttgtctcatggtattgctgataggcaaacagtctgatgcagttctcctgtgttgtgaagacgagaccaagctcacactacaggactggaagcttctttaggtacaatgaggaagaaggaagtctccactcttcacccccacacagatatgtctagatctgaaggtatttcaatatctgccatgcactggaaatggaatcagccttccttacaaccttgaagaagggcatagcttatccatgttcaagaagtgttactcctgactttcatgctgcttcctgcttcctggttgagctgaattctataactgtgctatccccaccagcgaagtgagaaaggagggagagagaggaagtgctggggtggagttcactgtgccttccttacatgaggctggaagaaactaactgataaccccacaaacccactgtcttctgcctttttgagcctcaatgacttgtccctaaccttgaccctaacctactccaaacttctgtggtcataagcattggtcattcctgattgagatgactggatattttaatatacaatgtcttgccagtagaaaatcacagcttaaaaaatgttttctaaaatctttttttctcatatccgcaatcactttattatgtttggaagtaaacaagttttagaacagccatctctaaaatcaactctggggctttctttaagtatatagttctattattgctaaacagaatttcaatgggcaattataacaactgattacttattcaaa

SEQ ID NO: 2047 - DNA, 1100 bp, artificial
  synthetic oligo
acttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagct

SEQ ID NO: 2048 - DNA, 1150 bp, artificial
  synthetic oligo
ggagagcttcttggccatgtcccaagcatgtctccacttactggttacttttgctctgtacattgtctgtgcatatatacaacacacttcccagtttaatcaaagtttgccatgcctcaaaccccctacctgtaatgtcacttggaatcatgcattcattcactattcagggatgaatatcataatgaatagatgcttttagaggagctttggcaaaaatctaagaaacctctgacaaagggtcatttttctgccttgggaaattagcaaagttttcatacatgaggaggcatttgaactggccttggaggatgagcaggccttagaggatgagcaggaattcaccaagcagaatatagaggactgtttcagaagataaattttatatcaaagattcaaagattagataagaatctgtcctatttctgtatctcaaagagtttatagtaccaaggcctgaaacgaagggtactctaactgtaagaggtctgttgctggatgcacacagcaaatcaatacaccaaggcaccaggttgtagcagagaaaaaggtttaaccatagggacaatgaacaggaagataggaggaaactcaaaatccatctctccaaggagtctggggctaggggctttaagggttttggagtgggccagagtgtggagatagttgattgcttgaaaagtgcaaggtgaagttgtgggacagggagatgaagaagctgtgttctcacactgattgggttcctctgcaggggacttcatattggttggtaccagctgtttcactggaattcaggatctgctgaaacaattcttaaacagaagccttgtgatttctaatgtcagagatcccattgataggaacaatggggctggaaatggtcaggatctggtgttacgtgacttgtggttacaaggaagtggcaccaagtgcagcctgaggaatgcttaatgattactctatttctgtccagatttcttgggaaccgtgtgaaaatggcttcggtgctgttttatcaatgaccaaagaatatcacaggcacttttagacaatataatttccccccagagaggaaaacaagttggagagcttggcattctataatattactctttaatattaaagaaatactattagtcatataaaattt

SEQ ID NO: 2049 - DNA, 1100 bp, artificial
  synthetic oligo
taatgctgccacaaatattcattacaggttttgtgtgaacacagccatttctctgagctaatgctcaatgtagccccttctaaggtataaaaatctctctaactatgtggcaaagcactctagaattgcagggttgaatgggctcttagaagtcatctagtccaactccaagccattagccttaaaataaaagtttttaagcttttctgtgagagcttatacgagtgcccagaggtatcagagtgaagctgaaaactttaacaggcaacattcatctagagagttcatatttctgaaacctggaacagtcaatcaagttccttttagggtaaataaaagagtctcactttaaatgagcggaagcaaagttttaaagcacatacagtacttggaatcccagcagcaggaaacagaaaccctgacctgaagaacaaaggtagtttcccttttgtctctgtttctctcccactatatgatagcatatggtctctcaggacatcttctccctgctcatgtattttactctctttttctttcctcaactatctttgtttctttgtgctcagtgtcacccctccacagaccctggatttccattccctcagtttaagccagacacagaggatttctatccttttctgaatcctgattcttattttttttttacaagagcacaaacccacttttatttatttacttttcattagtttaaatccttgagggatacagcatcacacggattttgtgtccaatggccttagcaggaggattgctttggaatttggaacaaaccatgccaccgtttccatgggcctgaattacctttccccagattattatggctttgtttggtttaccaccaggagtcactgtgttgttcttccctttgtacacataagcacatttcttgcccaaatagaattcagtttcatctcaggcataaacaccttcaattttaagaagaaatgtatgctccctttggttctagagaccccacttacagacggcaaaatgaccttggaccatagccttccagacatctttgccttttagaagtcctgttcccaacaggtctccacaggctgcaagatggtggaagg

SEQ ID NO: 2050 - DNA, 1400 bp, artificial
  synthetic oligo
gtgcctgcagaaatatctatggactgaaggtgggatccagtgatccatctggtgctctaggcataacaccaaaggccaaggacaatgtattaaactttaaaaaagaaaaaaaaatatacatataatagacaaaataaacaaagaagcttaaaaaccaaaactaataacagtcaaccatggcttaattcaactatgatgagtgatcagcaaatgtaatagtttaagccacaaagacatataaaataatgtattccagactatgaaatccacccccacccgcccactgcacaaaaaaaaaaaaaaaaaaacaactttccaaaaggttttacagcacaaagaatgatatttaatgaggcatgtggtgttaaatgcagcttccaaaaaaaaaaaaaaaaaagagtgctctggacctacaaaagtctaacctgtgtgctggctaggtttttcctgcccttccttgcttttgacattgctgacaatagtttacaggaatagcatatgctagcagactcaagaaacttaaccttgggctgggacttttgtaagtcaattagctaatttactgattaaatgtcatatattttcccaacaaacatttgtctgaccagtgcaaaagtgaccaaaagcaaaggtgatttctggtttgagtttgatttctggtttgagtttaacacttccacaaaattttgttcttgatttttaatacacctaaatatattgttatgggataatttaggaattagagagactgaggggttgaggaggatttattgtttaggtgtattggcctagttgcattaatatttaaaggactgggttttgaataaagagttgttattttttaagtattttgtggggcgggggaagatttgtaataatatagtatctgactgttaacagtggtatcaaaagaaaaacacagaaccatgtgaaaaatactggtccaggcatgttactgcctacattcttatagaaagacttatttagcggccaggcacaggtgctcacacctataatcccagcactttgggaggccaaggtgggcagatcacttgaggtcaggagttcgagaccagcctggccaacatagcgaaaccccatctctactaaaaatacaaaaattagccgggcgtggtggcgtgcgcctataatcccagctactcaggaggctgaggcacgagaattgcttgaaccccagaggaggaggttgcactgagctaagatcgtgccactgaactccagcctgggtgacagagcaagaatccatctcaaaacaaacaaaaaaacagaaagtcttatttaccaaatcttggtaaatttgggggtggggggattcgtgtatatgtatacacacacacacacacatatacatatatatatgaaagaaataaaactgggaa

SEQ ID NO: 2051 - DNA, 1250 bp, artificial
  synthetic oligo
gagtcctagaatggtttaccctccaggcctaataaattcaagcttagatgatgatgatgatgataacaatataatataatcaattaatattttatgtaaataccaaaataatactgataaaacaagggcaggttctttttttttttttttttttttgagacggagtctcgctctgtcacccaggctggagtacagtggcacaaacacagctcactgcaccctcgacctcccgggatcaagtgatcctcctgcctcagcctccagtgtagctgagactacaagcatgcaccaccatgcctgggtaatttttttttttttttttttttttagagatggggtcttaaaactatgttgccgaggctggccttgaactcctggcctcaggtgatcctccccctaccctggcctcccaaagtgctgggattacaggtgtgagccaccatgcccagcccaagggcaggttctgtttgatgaagggggtaatcatttatgtgatataatataaagggagaggtgctaggaaaatccccaatataaacataatacctcttctgtgctgttgtctacagttcaattatcagagtatttttttcctttggttgagtcgtgcccacttctcatgtcccacttgaaaagccataaacttactaacatgtcagtacaaatgtgcttatcacacagtgcactttccagagaggtgacaagcccaaaagacccccgtgcccaggaaggggtggggagttatgggagaagaaattagttagggagcagaaagcaggatcgggggctggttaaaagacagatcaaaggaaaactgaaagacccctcaaaggtagtttctaccaacctcatacttcacagcctcacaacctggcccagtctcaggacaaatggagatatatatatatatgcacttatacaattatatacgtaaattatgcgtgtgggtgtacttttttcccagcacactgatgttaagggagaaatgaaaaataccatgtaagtagataacacctaaaaagtaagcatcacgagtgagctatatagacaggatttccaggaagctaatcatatctcacaaagaaattgagatgccctctttatctttatctgaaaagaaagtctttccagctataataaacttataatttagaagagctcaaaaagtcttccagctttgttagtgaaaagcaacctgtctttaagtgccccaggtcatgtcttcttttctcatctcaaattattctggg

SEQ ID NO: 2052 - DNA, 1350 bp, artificial
  synthetic oligo
ttctggtcttttgattacaaacatttgttgacaaggcatgatatatatgaaaaaaatgtgttgtcttttttgagacttattccatctcttttttaaaaagaaagcacaatggtgtgtttgacttttcttttctttctttctttctttcttttttttttttttgagatggagtttcactcttgttgctcaggctggagtgcaatggcgcgatcttggctcaccgcaacctccgcctcccgggttcaagcgattcttctgcctcagcctcccgagtagctgtgattacgggcatgcgccaccacacccagctaattttgtatttttagtagagacagagtttctccacgttggtcaggctggtcttgaactcccgacctcaggtgatccacccgccttggcctcccaaagtgctgggattacaggcgtgagccaccgcgcccagcccttttctttcctttttttttttagagaccgtgcctcactctttgccctggctggagtgcattggtgccatcatagctcactgcagcctcgacctcccagagctcaagtgatcctcccacctcagcctcctgagtagctgggaccacaggtatgcgccaccaagcccagctaactttttttgtttgtttgttttagtaaagacgaggtctccctgtgttgccctgcctggtctcaaactgctaggctcaagcgatcctccctccttggcctctcaaagtgctgggattacaggcatgagccattgtgcttggccgtgttttacttttccaactgccaaatttgatccagtgcagttacttaattagattagattactgtttatattaaactcaaataatgattaaattgaaaaatttcgtgaaaagagctcacaaatgaaatcagccgaaatcagctagtgcttgtcttaacctatccttggctgtgtatgctgccttatcctcagagggcatacaaggctgagctgacagatgaatgacccctgttaatggagtacagatagttcacagaagccatatgtgatcagcagcacttgcaaatgtctcgctttcaatgctgccgcatggcaagaacacaggtggtgtcctcaagaggtctccctctatgctgtttgacctccacagcacactcttcacctgcagcttcagaatccaaggtctatccagaagacaggatatttttttaaaaaactttaaaaatagagatataacatacatacagttgtgacagctagtcagcaaagatggctccaatcttcatgctgtggcaatcccctcccacattgagtcaggctggcccatgacttgagttaaacaagagaatgtggcagaagtgaccgtgggccag

SEQ ID NO: 2053 - DNA, 1050 bp, artificial
  synthetic oligo
aaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgatt

SEQ ID NO: 2054 - DNA, 1000 bp, artificial
  synthetic oligo
agctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaag

SEQ ID NO: 2055 - DNA, 1000 bp, artificial
  synthetic oligo
ttctgtgctccatcctcacacctcttctgctcctgtccgtgtctttctgttttagtagggtccatatctacccgtgatgtgtttccttcccttctctcgttgtcttacttgattctgacccttactgaatattcgacccatccttctcctctcggccactcttgtgaagctgccctggccatttctccaaggcttccgcatgtccagcttcctcctgaattcaggcctcgccttgcagtggctcttcctgggtttctctgttcccaggtgttggggcttcttcctctttgaacaattcatgtctcagttccaatgtggcctctcagagaagtcttctgtgactgtccttcttggcacgtcctcccttccttgtcatcccctttcacacgccttcggaaagaattttgttcatttctgttttccctccccttgctgaccagaaggtcaaggtcaaggcctggtgtgtgcggctgcctggtgtgtgcggctgcccgctctgtccccgcctctctctgtccccgcctcacgattgtgcatggcgccctggaggtgctcagtgaggatgtgttcaatgaagaagtgaattctaggagtcaagacacagctcagcaggagtggccatgcacgctgaaattcacgggaccccaaggcagaggaaagctgggaggagccagtggatttggactgcagaaagccggtggtcggctgtggctaactgcgcttgcaggacccacgaggcggaaggtggtggaaggagggactggggggtgggttcagggaggaaaagaaacgtgagaatttgagtggctggagaagaaaacatgcggccgcaagcgtgtgaggcaagcctcgggccaggggcttggctgtccttcgtggtgggctggtcctgctgtcgtgttgccatcgggggtgggagctggggctcctggcctgtagacagggcttggcttcaggcaccaggagccgctgtctacacgtaagagaggcgcgaagagct

SEQ ID NO: 2056 - DNA, 2300 bp, artificial
  synthetic oligo
ctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcct

SEQ ID NO: 2057 - DNA, 1000 bp, artificial
  synthetic oligo
ggaactaaaacacttatttttatgacaactccagccaaagtcccagtttgactggaccaacttgggtcaggtgttcattcctaaaccaatcactgaatcactatggctctaggaatggaacactttgattttctaggcttcatatgtgtgtcctcctccttgattccaacggacagagttagctccagacaaactatatagactaagactgggatggtgttaccaaaggaagggaaggtggattgaacagccacaatcgacaaacttccatgacaaacatctacaaggtagggatggctagcaagtgcatagcttgcttcttaaagggttgtagatatgcatccccattttacctaaagctttctcatgattcacacccccaaccctccctccagctataaggcagtgattttcaaaactttccacctccacctccagcaaaaaaaataaaattcatattaaaaacgagtatccatatgaactgaactgaaacaaatgcttcatcaaacaatatttatttttcactacctgcaatgcactttgatagtttttgttctgttctattctactctagtttaattgaatatattccattatgttccctcccttccaccccattccattttattgttgtagttattagtcagggcaatgcttgctagctgctgaaacaaacagcccctaaatctcagtgatttaacaaaagtgtatttcttgttcatgttgtagcctgatccttattaggaagctctgctcaatggccttcttcctcctctagggctccaggctctttctatatcatggtgccaccatcttcaacacaggatcatggcataaatggggacagggaggatagagggaaagggaggagatgggaggggatgaaaggagagggaaacggaggggaagggagaggataggagagaatcactcgggaggatttatagttaggcttgtaagtggcttctaccacttttgcctgtactctgctggccagaaa

SEQ ID NO: 2058 - DNA, 1150 bp, artificial
  synthetic oligo
tctgtctgtcccagccagtctagctagttgttcctctttctctctatcccatcacccatgatacatttgcattcaggagcatgcacttgacaaaactctatactgcagggttccctttctgcagagggaagcctggaatggtgggatctgaggtcgagagtcacctagcaagcagcaagtttaagaggtccagccggtgagctggactacttagggagggacggggagggctgtgtcagaacagaagcctgtagcagggagttggacctctcagccacgaggaccatatgcacccttgggttgtgtgtgaggggtgttggtgctgctaagctgcctcatcaaagaatgtgagtggcagaaaaggatcaatccagcagaattttgacattgaaaatccactaacacctctctcagcacatgtcccagcgtcccaatgtcatatcataccctcatttactccagcaccagaggtagaaatgggataggagacaaagggctagactccttcctctaggctggagtactcatttccttcctttcttcccttgaggtgaggaggcttctccttgggatgtcctctggcttccagcttcttggctgttcaaggtgtgccccgccatatacaaaagttcatggttgtggcttgggccttccctggccgaagtgactgggaccctgggagtgaagccctgtgtatggaaccaggctctctgaaaccacactcatgagtcctgagaatgccccaaggcctctgccatgctgcctcctcccacgccccttcatcttctttccccttcctcccccactccccttctccttgtaccagacagcacggcacagtcctgaggaacctgggtgccctcctgcatcatctacatccaaggcaatgttggcgaaagaaaaactgacccaagaacaattgccagctaatatattactgtgattattgaagtcattctgtactttctggaaagaaaacatcactaacttgttaaatgggtcttctttcttggtctgacaggattagtcttccatcatcttccttcctacaaagacaactggaactttccagagccaagacctttccgtcccctttgccagtctttctctgttccatcgaagcttccctatcatgtgttcacattgtcag

SEQ ID NO: 2059 - DNA, 1100 bp, artificial
  synthetic oligo
ctgtgctatttttgcaactcttctgtaagtccaaaattatccccaaataaaaactttaaaaataaaagactgctaagtagcatcaagagtgaattcatcactttgcactgggcctgcaaatgatgtaaccagtcctgtatggaagtatatggagaactggacgaaatatttcctaggatgcaaagcaatgaagcagcagcaaaatgactgccctgagcttgagagggtcctggaaggggtggagacaggagctgctcaatctgaatgggacttggggacaggaataagaatggctgtggggctgagtgcagtggctcatgcctgtaatcccagcactctgggaggccgaggtggacagaccgcttgagctcaagagtttgagaccaccctgtgcaacatagcaagacccccatctccacaaaaagtacaaaaattagccaggcgtgggggtgcacacctgtagtcccagctacttaggaggctgaggtgggaggatcgcttgtgcctgggaggcggaggttgcagtaagcagagatcactccattgcactccagcctgagtgacagagtgaaaccctgtctcaaaaaaaaaaaaaagctttatatattaataatatttaagaatttttttaaataaaatggctgtggaccactgactgaagaccaactgggacaagggacacacacctcaactgatgatggctacagaaaacaacaaaaatctgattctgatatcctttccccagtttggaattgtagaagacccctagaacttagaagtaagtctggagaaaatgacggaaacaccactcattggtattctcccaaacaacctccgttcgtggcccgggttgttttcttgtcttccaaggaaagtcaaaagccttgaatgactaagattaagtttgctcataatagaaattaagtagttatagaaaaataaagttagatttcctgccctcctgtgtttgtggactgagatttgtacctgtctcacccatcagttttccaaattgattttactagctatttgagattacaaattattctacgttgaagtagatgaacatattttttagcatagtgagaaaggtcattgca

SEQ ID NO: 2060 - DNA, 1100 bp, artificial
  synthetic oligo
tcaaccaaattctattttttaagctgttttttttttctgactataatgcaagctataagtaattacattctgatgtattcaaacaaaggaactatacagcagtgagaataaaccaactattgcagcacatagcaagaagtaaaaaaagccagacacaagccaggtgtggtggcacgtgcctatagttccagctacacaggagctgagccaggaggatcaattgagccccggagttcaagtacagcatgggcaacacagtgggaccctgtctctgaaaaaaatgccagatataaaagagagtatagcatatgattcaattggtataaaactcaaaaacagaaaaaagtaatctatggtgggagaagtcaggatagtggttaccttacaaagaagagtagtgactgaaagggggtggataggattctagggagctcataaccttatatttcttgggatgggtgctggttatatgcatgtattactttgaaatttatttaagctgtatatttatgatgtgtgcatattttgtatgtcatagacttccataaaaagttcacctatggccgggcgtggtggctcatgcctgtaatcccagcactttggggggctgaggcgggcggatcacttgaggccaggagttcaagaccagcctggccaacaatgtgaactcctctctctattaaaaatacaaaaattagccaggcgtggtggtggcagctactcaggaagctgaggcaggagagtcacttgagcccgggaggcagagattgcagtgagccgagatcacaccactgcactccaacctgggcgacagagagagactctgtctcaaaaaaaaaaaaaaaaaaaaaaaaagaaagaaaaaaaaattcacctaaaaaattcagctcattacaaataattcagaatctaaataaaaagagaaagcaatccatcagcaataaatattgtaacctttaaatacatttatttatcttactcatatatttttaagcaattttgtgtgtcatttataattttaaaaatatttttaaatgcctgcataatattccattttatggatgtccagaggttctgttatctgttttccactgtgggac

SEQ ID NO: 2061 - DNA, 2600 bp, artificial
  synthetic oligo
gcgcctgtagtcccagctactcgggaggctgaggccggagaatcgcttgaacctgggaggtggaggttgcagtgagccgagattgcgccattgcactccagcctgggcgacagagagagactctgcctcaaaaaaacaaaacaaaacaaacaaacaaaaacaagaaattgtttgaacattatactaccaaggcgcaaggctttcaattgccatcaactcatcagatgaggcacagctcacaatgagttctgaaaacggcttttcacgccgggaccactttgaggaacacacagcaaaacggggccaattacaacagccagaccgctccgtttgttttaagaacaaccactttctaaaccttcctgcgggactctcaaaggcagcccttcctttgccgccagaaccgtatcccatcgcccagcacttgccacaggccggacaagtgaggctcaaaaaggcacccagcccacgcctcgctttagaaagcaaggcgcagcaaagctgctggaaaaatcgcttttagtcaacctgaagccagtttgccgcactcggggagagccgggagggacgcgatccgccaccagccaaatcagggcctttcctcttaacgaccacgcggcaagggggccgggccctcgcacgcctcgacggcctcccccactccaaagggactccgatttcgcaggatctcccaacttccgcctctgttcccaacaccctacgtgtttctcttcctcctcatttacgtatttacaataaaacagcgaagctgcacagtctgtctctaaatcaaactcggttaccatcaaagcctcagactctatgtctcaaccgcaaaatgtctgacaggaaatcaactcgggaatttgtcaattctttagactcaaagctctcacccagtggggtggttcacgccagtaatcctagcactttgggagactgaggcgggagcattgcctgagcccaggagttcgagaccagtgtgggcaacatgacgaaatcccgtctcaacaaaaaatacaaaaattagccgggcgtggtggtgcacgcctgtagtctccgctcctcaggaggctgaggtgagaggaccgcttgaatccaggaagcggaggctgcagtgagccgacatggcgcccctgcactcccacctgggcaccagagcaagactctgtctgaaaacaaaacaaaacaaaacaaaaccaagcaaaaacaaaaacaaaaaacaacaacaaaaaacctctgtgaaagtctgagtcattcctcattcctcgcccccccataccccgcctcaccaaaaagagaacagctgaaaaaggataagctcgtcccagaaagtcagcatcaagtatctaataagcttcgaaatctcaaaatgtaacccacgcgggcaccccgggagaggcggcgggtaccacccaaagcaccccctcagaacacccggaatttgaggctgtgccccagccgctatgccaaaacgctgaacagggctgtgttccgcggctgcccaccagggaaaaccaataaattcaagaaaaagtgcggccgcatagatctgtatcgccggagcccggcgtcgcgagcgccgagattgtttcccagccactcgaggctccggaaagaaccgcgggccagagggcaaccaggcccagcctcttgacgcactctcggcacaagcccaagtcaccccaaccctgagccaccaagagccacggagacgccatgagcctcaggatcacctcacgtctccgggacatcttgagcccctgagacgacctgaaccctgggccatctcggtccaccacgccaaatttcccaccggcgcgctgagcaatcggcggcagatggccaatacccagaggccgccccccgacacgccccggtcaatgactagccaatcctgccgcccctgaatggccacctaagtgggtgccatccagactcttgacagaacttgaggcccaagctagcgggccagttgaggcgaggtcactttaccctgttcctgggtcctctctgacatcgtgagatggcggggtctggctctgaggcccgagacctgaggcccgagacctgaggcctacgtctgcgccgcggctctgaggtaactgcttggtaactgtgtggtaactgcgtacactcgttgtccgaggcacaatgaggcccgggcaggagcctggaccacgtctccgcggctgcgcagtagcgcttggcatgcgtgcgtgactcctgggggtcaaagggcctcgccctctcccccacttttgacctactttcttaaagagtcccttttacaaaaatatacatatgtatgtatatatatatttgtactatatatgtgtgtgtgaatatatgtagatatagatacagaagtagagatagagatagagataatgaactggaagccaacagtgtaattctgctcgtcccaaaacgcacatcataaaaaaaaagtccaatgtaagagactttctaaatcttcctgcgggactctcaaaggcagcccttcctttgccgcactcggggagagccgggagggaggcgatccgccaccagccaaatcagggcctttcctcttaacgaccacgcggcaagggggccgg

SEQ ID NO: 2062 - DNA, 1200 bp, artificial
  synthetic oligo
tccacgcactgtcagcaacaggatcaggacgttgaagcctcacaccgaccaacgaggcaggttcctagcatcaacctagttgatgtgcagtggaagcaagcaggccttgccctgcctgctgggcctgcaagaagaggggaagagttgacttaaatgcagcccacaggacacgagaggggacaatatggccagagagcagcatccagctggccatggcgccactctccacttgtttccactccactccattcaaactcctgccaccccggggggtccatctcaccaggcacagtggtcgtcacccgtggcctggagccccggacacagctccagtggcctggccaaggtgtgcaacgccatgctttcatgaggccctgagagcctgctgctttgttgaccccagtgtttgcagtgggtttttggccctaagggcagcaggtttgacaaaggagtgtgtattagtcagggttctccagagggacagaactaataggatagatgtatatataaaggggagtttattaaggaggattgactcacacgatcacaaggtaaagtcccacaatagaccatctgcaagctgaggagcaaggaagccagtctgagtcccaaaacctcaaaagtagggaagccagcagtgcagccttcagtctgtggtcgaaggtccaagagtccaaaagctgaagaacttggagtccgatgtttgagagcaggaagcatccagcatggtagaaagatgtaggccagaacactaagccagtctagtccttccatgctcttctgcctgcttttatcctggccgtgctgacagctgattagatggtgcccacccagattgagagtaggtctgcctctcccagtccactaagtcaaatgttaatctccttggcaacaccctcacagacacacccagggacaatactttgcatccttcaatccaatcaggttgaaactcaatattaaccatcagtgggtatgttctttgtaaggacagggaaaggcccagaggagctgcagagcagcaccgagctccggccatcggttgtgaaagctggatcccatgtgttcatgggcacagacacgtgtctgtgtgtgagtgtgtgcatgcgtgtgtcagagagaaaaagagagaggagggagggaggaagatggatggggttgagatggcgatgaaaaggggagacaggctgagcatgggac

SEQ ID NO: 2063 - DNA, 2500 bp, artificial
  synthetic oligo
gcagctatgacctcatacactgcctattttccgtgcttttcctaaccagaagagaccctatttttctcctttgcttgttaaagcgaaaataattatgcagctttccatagatttgtccccaatgtctttttaaaaaaattttttttctttattttctaaaagtagcattggaaatgttatctccttcaatttcatcacctcttcatcctccttggaaacccgatccatggtgggtattaagatctttacatttgtactggttgggcgatgacttcattgctttcaagccagctgggggatcttgtgtggcagagcatcggaccgaagcggaggtgtgggtcgttgctgctgctgctgctgctactgctgcaacagctctttgcacgcgcccagctgctgtgtaaggaatcctcaggctgctaggtctttgcgcctaactcacccaagggaccgcaagctgctggatgagtgtacgtgtgagtgtgtgttgtgtgtgtgcatatgtgcgtgtgtgtgtgcacacgcagcggcaacagttgggcagcagcagcaatggacttcgatatcatttttaccaacaacagagataaaccatcctccatcctgtatttctcagctcccgccccgagtatgttctccccctcttctccgacttcccccaccccagcccccggcacgggtccctccggagggagggcagggtagctgcgctgcaggcaggattccctcttttttccgcagtgacaggcggattccggggcctcctcgccacctcctacccccgcagccacccctttctcagtcacgatctccccaccccaccaccgtcgaccctctccctgcttccccgctctaccccccggcgtcgactccaggctcgggccccgcccctctcagcctctccagcccaggttgctagggcttggcggggcaaccaaacctggcgtgccaggaggcgcggcgcgcgcgtgagcgcgcaggcgagcttgtataaggaaccagcgttcttcggcttcggagactcgagcacgagcggcgcgagcccgaaccccaggacaagcgcttcctcctcattggctcctaccagaagggggcggggtaaaggcgggatcgggcaaaacctgaggtgctttcccattggtccgaacgggccggctggggcggggcagttagcaaaataggctgcgcgttcgcttctgctagagggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaattggctggaatttaagctgattttagaaagtattgttgacaccgaatgatttctttctgtgcatctgaattaggtttgtttgaacgtaatggttatatagttaatgtaaaagattacacaaattaatttgtctgagagcgtttgtcagaaacaggagacagagatgtgtatagaacaggattatcgttttaggtaacatctgctggaacatttccagcttgtttctttcttgctgtagggtta

SEQ ID NO: 2064 - DNA, 1200 bp, artificial
  synthetic oligo
tatatatatatatatatagtcaggagtctactgcgtttagtcaatggtgaagaagacttctgtctcaatccacaaagattaataggatgtagagttgcccaaaggtttaagttcgtctgtgtttgtgctggtgaagtccttttaaccatttggctaatgggtaacttgctaggttctcaaaaggctcccctctgtcagtctcaaacaataggagaggccacatctatataaatggatgattctctacccacatcaataacatcagaccatacccgtgaagcaaagtgcattcaatgatccagtgagttgaaatagtccaaatggtcagtcttaagagttcaggcaactgcatgctgatatggaaactcagacaaattttttttttgagcttaagaatagcattcatttgcaaacaaactgtgctgggcaccaaagcaagcccaggaaagagagcacagcacattgtgggggaaagcgcagatgatccactgtgctgtggagtcggtgctctgacagagggcagtgacaggagctcggggacaggaggggaagtcccagagggtgcgagctgaagttggtttgggataagcccaacttacccggttgtttccagtctggtccttgtagtaaatccagttcaggcgctcatcggtcctgtactgcacgctgtacttggtcatccactcatcgatgtcacagcgcccctgggtgaggatccctgaaatcactttgatctccttcagatctatctgtaaccactggctactgtcctggaacttggagagccaggcacacctgccgagaacataccgagtcaccgagagactccccctgtgcatgtctgcaaaaagcccgcaggtgctggctctcgaggggatgccagcatccaaagagccccctgccaagctcgggcagtctgggctgcagtctgagccttgtctcctaggaatggccagcttccgttatacttaacttgcatctcattctccctctccctgcatctccacctcccaagaaaagatttccagattcgactaatttgtcaaagaaatgcctcagagtgtggctgaaattgcctttgggagtggttgaacatgtctgtctgcaaaacacgcaggtgcatggctgttagaccaccagcccctgccctctgcttgagactcccagggtgaacctttctgcgcatttcactctcttcac

SEQ ID NO: 2065 - DNA, 1500 bp, artificial
  synthetic oligo
ctcaagtgatcctcccacctcattctcctagttttctgatgatgaatgataaactgcaattaaggcaaatcatagtattttctccagaatttttcaaaagccagtaaagttgaatgaaacatgcttgcagagacggccatgccctgtccccagaggctaaaaacaggccagcttcagacctctggccggggaggcttaacttcctttctgccccaatgcacgaaaggaataggcctgatctcactagtatctgcagctctgtgggtctgagggtgagggcacagaatttgtagtttattgagtactcaagtactcaagaatgcagtttccaggactccaccccagagcaattgcatttttaacaagccaacttttgaaagtgcaccttgaaaaccttggcctgccagggaagacattctttctgtgggctggggatcccgaggactgagtgcctgcggactcgagggctcctcccccacccgcgacacccctccagctgggaagacaagcccgagcgatcagggggaggggcacaaggccaggtggcagggatttttcatgggcaaaattctaaccttgggtgtctctgaggcccctccactttgagcatttgatgactgaacctcctttttgttttccacccccacccgccgccgccgccccgctcagggctactagctctgagagagtaggcagaggggaagggaaaaagccagtgccacctctcccagtcaccttattcttggcactttgctcttcttcatctgtttccccttcacatctcttttgccatttcttcccaaatagctcatctaacactccagagcggtctgtagccctgcaggggtacctggccagggccaatggccttgacagcctgggagggcctgtccaggcagcagagaatgtgtggctcactctgcgatctaaagacccgtgtgtccagacgtggatgctgtacttactccccagggaaggtgacgctctcactgtcaccttggcttcagctggtgtctgggagccgatgcctgcctcccgggccccaagcttcattccactgccctctgaatattttccaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccggtaagcagagactctagaccggtggggctcagcctgggctgtacctcggaattgcccgaggagctgtagaaatgcagatgttcaggccacacccccagggattctgacatcattggcctgggcatggggacaaagctgcaggtgattgtaatgggcagtcaaggtcaagcaggcctgcgtccagccaatgacacctggggtaggggcccaccctctcagcgtgtgcgcaggccagttg

SEQ ID NO: 2066 - DNA, 1600 bp, artificial
  synthetic oligo
ccattaaacctctttcctttataaattacccagtcttagctagttctttattagcagtgtgagaacagactaatacaggcccttacccagtcattgacctagaggggctggactgccatagcgggatcgcagcccctgatgactcccttcctggggtccctgggcctgtggggaggacagccatcctaacaggagcctatctggtgttgtcattttagaaagccttccggagaatgtacttggagctcctaataagatatctcgggccaaggaaaatgtcacatttctttgctcttggcaggaatcccagctccttggcttgggagcaccctttctcccatgctgaacagaaacttcatttggccattatgttcattgccaattaataaattataggagaacaaattaatttacttatcacttgcagctttggagaaaaactcgttcaaagcagggaaagtggggtgataaaaagatccctgcaggaaaaacgttggggatccccggggccacttacatgttgggtctgagtgggtgaaatcactcttcattacaaagctctcagaggatccgcagcaggggcacctcgtccacaacccccgcccccctgcccccagctggcctccaaagattgtggtgaggttccaaatgaggtgacaacattggaacttgctgcatcctgaacgtgtgcactgagtgatgagggtgctggcgctctggttgtggggaccctgactacacagccccgggtgtggctcaaagtgtcagtctcccactgcctaccagtgctacagaccccaccctgcaaatctcctaaagggagaaacctgctcccggctccaagcacgtggttgcagtaggaacacctgggaacacacgaaagcgtgctgggtggggtcaggaggctcagctctgtctgcttgggctcaccgctaatgtgtgtgagctggggcttgcatttcctcgcctacaacaaaagtgacggacagaatgcagggaaggcccaggtagcacccctatcctgtgagttctgcctccacctgcactgctgcctgtgggttgtgtgtgaagcacgtgaggccctgtccctcagtgctcagcgatgccgcgggtggtctgagatgatgttggtggtgatggtgatgaaaactcacacactagcacttctaccaagcccattggtattctaagggtttcacccatattaactcattaatcttcacaaccagcctatgaggttactgttattatcactcctattttacacaggaagagacagacacaggtgaagccacttgtcaacattgtgcagctggtacgcggtggggcagagcccagtcaggctccggggcctgtgtgtgggcactactgtgcgctgtctgctgtgtcccggtagccgagttaaccaaaagcagcacagagatcatgaaacttcattctaacctgagctttcaacctcctccctctcatcaaattttacttaaaatttcagaaactagcaagagtcgaaatggcccgatgtcccctccttctgtttcccctgccgcttgtccccatggccctgggggcatccgcaggagggaggtgcccctggggctgg

SEQ ID NO: 2067 - DNA, 1900 bp, artificial
  synthetic oligo
tcactgcaacctctgcctcccaggttcaagcgatttttctgcctcagcctccaagtagctgggactacaggcgtgcgtcaccatgcctgcctaatttttgtatttttaggtagagatggggtttcgccatgttagatctcccaaagtgctgggattacaggtgtgagccagtgcactgggccttaaatccaaatataactgggtatttttttgtttttttttttttttttgaggcagagtctcactttgttgcccagactgtagtgcagtggcgtgatcttggctcactgcaaccttcgcctcccaggttcaagtgattctcctgcctcagcctcctgagtagcggggattacaggcgtgtgccaccatgcccggctaatttttgtatttttagtagagacgaagtttcaccatgttggccaggctgctctcgaacccctaaccttaagtgatccacccccacctcggcctcccaaagtgctgggattacaggcctgagccaccgtgcccggccggcgttttgtatttttagttgtcaactctggcaaccctacatggactttgaagtcatacaacctgatttcagatgcccctctgccatcaagggtatgggaaactctggacaaatgacatgggcattcggagcctccatttatcgtaaccacaaccacatcccgggaccatagcaaagatgagagcgaatgtacgtgaagcacgtagcacaggaagcggtatctcgttgtagtggaagctgttggccccgctgcatcccctttattggccggtgcactcatcctccagcttctaggaatgttgggtgccagcaacgcacagcgaccccctttcctggtgcattgccctggactgatgggaggtgcttgcctaagagcttgtgtcccatccgcgtcccccccaactgcccccattgccacccgcgggcagccagcagtcactggctaactgatggcagaggctgcttttatcttgcagtgctcactccagagccccctgtggcgtcgggctggctgggttccacctgatgccacaccctgctcagctccttcccctgtcactcttgcttccttccaggctgctccctggagcacactcttggcatttcacttgtacaacatgcctggccctggcacgctgctggtgctggtgtgcacactgatcacataagcttgtgagcattcagcgctgaaggccaaggatgccttgtgctctgagaatgggatctgcttgggggcaggagagacttggggtcggggtgcgttgctggggaacagacaagggatctgtcgcctcctgggaagctgggaaatggtgtggggtggggcgactgggagaggacggccagggacagcttcaggcctggtgtcctgcaaaacctgacacctagcagatgggaagatgcggctcagctacctcctcccggagccaggctgaggaggtcacgtgggcccaggaggttcagcctcagttgggctgtgcttggggaaataaatcatcaggactcaatgcagaaaaatgacatgaattagggggctcgtctgggtgccacgcgaacctctccctgtctctccaccttgcaggcatgcttttgggtaccgacacatgttcctccaggaggagtggtggaaaggaggaatcctttggcctccaaccctggaagaaggtgtatagttttaaagggcaaggcttggctttgaattgcagctctgccacttctttctccttctctcccttcccttcccttttccttctcttcccttttccttccctttccctttcccgacagtcttctctgttggccaggctggagtgcagtgatgcactctctgctcattgcaatctccacctccccgagttcaagagattctcctgcctcagcctcctg

SEQ ID NO: 2068 - DNA, 1400 bp, artificial
  synthetic oligo
agacagcggagggagctgaggaagggaacaggcatcgcttctctctccctcttctgtcatttcatcacccccattttccagttactagattatctcccctaaatagcagcaaagcaggggctgctcccgaaggctgtcagctcctcaaaataggtggaaggaagtcacatggcctcggcactggctcccttcctggctccgcctctcacacatgtccctccagacctgcggtgaaatgaactgcttctcccctctgcctctgccatggctccactgccccctaacctttaaagcagatctctctgggcagggttggcaatacttgtcattcttcccagtgacttgggacaaaagccaaagtctggactccttggtggctccactcccgccccctgcagacgtgttgggtgcagtactgcctcccacgttcgcactggcggttccttgctgcccggcaccgtctcctccagctaaagtgaggctcaggccctcacttccttcaggtcgctgatcacatcttgcccactgagatcttctccagtcatcccagaggacaggccctctgtgctcccaggcctccccacccgttcctctgcttcgttctgcccccgatatgctgcgaaaatcatcactccttgttcattttccggggcggggaggaggaggggtcagtctcacttcctccctcggctgagctgcaggagactcagagatggccttggcctcacccagctgtgctgtccccacccagccggctgctttgacatttaaaggactagtccgatcctgctgggtcgcattcttgagcaactccggcgctgtggccctgcactttctggaggactgagtgttttactcagccttcacctatgaggagcccgtgagacccaggcgagggttgggagggtcaaatccccacctcctgccccaacccatcttgagcctctaccctcttcccccagcatagctgagcaagtgggactggggctggtggaggggtagtgcctgccattcaggggccgaagacagtggctttgctaaggcccctccacccccagccaagcccaggaagccccctgcatcccctccaccgagtgccggcagttcccaggctgcctggcctgtgcccacctgtccccgcgttttctgccgctccacaccccctagtcccggctctggtcactctgcggagcctctgctaaccctgtgctgacagtgagctccccgacccgggctccatcttgacccctcttgcaccgcagacttatttttgactctttgccctactaggcatggagccctttgtgcctcagccagccaagcccagatccagccacgtggacgtgtgctgacagcaccgtcgatgcacagtctccaccaagctgggacaaaggtacaca

SEQ ID NO: 2069 - DNA, 1000 bp, artificial
  synthetic oligo
accacagccggcccacaaaaatattttctttacgtccttattctataagctttgatctattttttagttttatttattttactttttaaactttttttaaaaaatgaaaacacaaacacacacattaggcctatgcagggccaggatcatccatcactgcttccacctccacagcttgtcccactggaaggtcttcaggggcagtaatgtacatggagctgtcatctcctaagataacaatgctttctcctgtaatccctcttgaagaactggtctgcggctgtttcacagttaacgttttttaataagtaaaaggagtacactctaaatacgcaaaccagcaacatacttatgtattatcaagtattatgtactatacataattgtatgtgctagacctgtacacgactggcagcgcaggaggtttactgatactggcatcgccacaaacatgtgagcagtgcatggtgctacaaagtcactacagctacgatgtcactaggtgacagaaaggtttcagctccattataatcttaggggaccaccgccatatatgcggtctgccattgaccaaaaagttatgtggtgcataactgtatatatttttttttaaaagacaaatccttgagaatgaagaaaaacaagaaagaagacgacaggaacagaatttcagaagcgggaaagctgacagatgaaagataagtgatttagctgacacaaggcaaccaattcccaagtctgcagtggagaaatccgagagctggtcagttacacccaaggctcatcagaagtccctggggcctgctgcactatgtgcttctggaactggggcctagaaggggtgtccaaaacaaggaaggctggggagaagctatctgagaagcagtgagctccctggacatccgcttcaactacacccagcttgatgaccacctcactcactctgacagaagactggagggtctctcagaagagggtaaaggaggaaggggctcgaaga

SEQ ID NO: 2070 - DNA, 1150 bp, artificial
  synthetic oligo
cgtttcagtgtcgcacgctgtaatgggtgggagccccgagggcgcacttctaccaagatattcctgaatccggagatcagatgtcagaccacttgagaggggaatttggagagagcagtaaacgagaaatgtcccagtaaaggattcagttcgatggttttcctggtgaaggactggaaatacaccgggttcccagaaaccgggatctcgggcgctctgcctgctgggggtcgaggtggagggggtatataaagtgagttgtccctggtcccctctacctttctgtctcagcatctctcctcctgcatggtcatagaataaaaactagatctggataggacttacagatcccctaagcaatttgtcaaagtaccctattttacagatgggaaaatggaggctcagttctacaatacgaattagttgtagagaccagggaaaaaataagcgctctgaattccctttccggctcattttactgcccccctcccccgccgcctttatagtcgaataacacctgtgtttgcaaaatgctttgtcgttttaaaggcatcgttctctttcgttaaacctgcgggagaatataccatttttcctttacaactagaacaaaattctggattctgaattgcattcacagccctggagacgcgatggttatcaagtgcagatctttaaggcatatcctggctgactctgccattttagacacatgatgggcgagatgtatattctgctttgcaggaggggttgaatttgttttgcaaacaccagtttattaacactcacaacattctaactgaataaatgaatggacagtcttttcagagagacttttaactgattggattaagggagagtagagtcaggaagctcatccaggttacataaattaaaagttttgatgaaggggaaaatggtgtattaaataaacacacccggtattactccaacgggttaaattggttccgtttgaatgaacttaacacgtatttttaacttacatataacttttgcatattaacttctttatttttgctttacatagacctcatacctaaagaattttcatacaccgctagtgggagtgtaaatttttacaagcattttggaaaactctttggcagaatctattaaagctgagagtaca

SEQ ID NO: 2071 - DNA, 1050 bp, artificial
  synthetic oligo
tactcgggaggctgaggcaggagaattgcttgaacccaggaggcaggggttgcagtgagccaagattgcgccactgcactccagcctgggcgacagagcaagacttcatctcaaaaaacaaaacaaaacaaaaaaagaatcactggaagggaaaagagagaataatcaccaaagtttctttattaatatcaaagttgatttcaaagtaaagaccattcccagatagagttttttcataatgattaaagatgacataatcctaaatatttatttagcattatttatcacgaggacataaaaatcctagatgtttatatgcctgataacagagctgcaaaatacttgaggtaaaacttatagaactggaaaaatagaaaattctacaattatgatcagagatttcaacatacctacctcagaagttgatagaactagtagacatataaaatcaataaggatatagaattgaacaacactatcaacccacttgacattataaaacattctacccaacaacagcagaatacacattattttcaagtacacatggaaacttttagcaagatggaacctattctgggcctgttttaaaatgtaggtttaattattattcaaatatggtgagtccaacagaacaggagacaattgccattgaaaatatagtttgttctactcacagatcccaagaggaggggaaattcatgtcacaggggactacacagggaagtaccaaggtcagtcagaaggctcagggagaggtaggaactgtgtgcaagagcctttattgtgggtttccttgagcgggaatggtgagacagggcaagcaggcttgaaactggctaatttaaataatttcagcctgctctggccataggagttttctgtccctagtacctggccctgggatggttagggcagacgggtagagtggcctggattgtaagagctccataatggaggtggttgggtatgggctctggatttgttggtttgcatatgaaaagcacagtcccaagtgagttgtttgctatctctaggagctatctagcc

SEQ ID NO: 2072 - DNA, 2050 bp, artificial
  synthetic oligo
ttgcaggaagcagaacagcaatcattctttcatcacagatttccatggaaatccaggaaatgaaacagaaaggaagttgatcaaagaactgctttaggtttgtagtctgattttcatgaaagttcgttcaggagaccatactagacaatctcaaagaccaatttaggcctgaaatgcatcttcttttttttttccctacacattaggatttgggtctggattgggaacaggatgtaatataccaatacaggccatgagcctggctgctgaacttcctgagttcaaaagacgtggttggttgccacatcccgccatggatttggtctattttatagctagaggcaaagatccagtgtttgagcagaaatcctgggatggttctgagattgctgttgatgatcccaaacctaccctggaagtcttcagaaggacaaatctatccatctctctagggcacttagaagaggacctggggttggcctggagcctctgaaagcaattaccagcaaagccgattccctcgtgggaatccacttcagcttttacactcatctagagctagcacagatgataaagcaggtttgccgtcagtgccctgtatcccctgttagagcccacagaccccttattgttctttccctttcttcctcccaggtacttaatgcactcatgaggcccctgcatggtccagcgtattccaccagctagatgaaccctggtgcctcccagccactgtcacacctcacttggatcctgcagcagtgtctggtcttggacctcctacaatctgttttctatcctagagcacaaatcttatcaggttatagtctttcctaaaacccttccttggctttccattagcattaggttggacggcacgcttctttccatggtgggcttgtcatttaacatctggcctgtgctgctctctccagcctcacctcttgctactttcctacgcacatgcaatgctctctccagcctcacctcttgctactttcctacgcacatgcaatgctctctgcagaattttcttcagttcctttactgcaccatgccttctggccttcatatctgctattccctctcccagaatactctttccttccttctttgcccaggtcatcattgtcatggggtcactcctcatctttctccaccatgaagccccctaatttccctaggctggtttctgttctcttacagccacctgtacgtctccagtcacacctccttgtcactgcttcgttggttgcctgtcatccctgactagacagaaggctccacggatgcaggaactttacctgttttgtttgccatcaatccgtccaggcacctggatgtattcttactgacatgcttagcagatttagcagaaactcaccgtcacccttggcctgatggatcttgaaaaataacaatactatctaatatttccacttcggggtctacaacattacttcctttgagacatcatgttgagaggtaggcagatgagctccactttaatataccagtgccctggggctcagggcgaaagcctcaagcgtcattgtctattcactcagtggctacttctgtctacaatacaaaaggcctcatgttagtttctaaggatacaaagatgaaaaaagaatgatctttgtacctgagaatctcaaagtctagacggaaacaaagtgtgagaagttgtaatggaggtatgaacaaaatgtggtggaaacagaaaagctactgactcgacttggggaaggtggaaaggtcacagacagtccctcctgtcttcctgcaagcttccactgatcctttgagactaacttaacctgttacccgatccttgtcttttctcctctctatccctttttgaggctccctcagttctacatagaacaaactgaaccgtggtcccatagcacacttcttttataacacctatcaagttcctcgagtctaggaaatttctgtaagtcaggaaaagcggaagtcgggcccaccagatggctgctacatgtgggctgaggagcctccagagagagaacttgatcccaga

SEQ ID NO: 2073 - DNA, 2000 bp, artificial
  synthetic oligo
agaaccctctgacatgttctctatccaaggcttcctaaggaccctcattcggactgatggactgtggtttcttgtacgtacacagatgcagctgacgcaagggttttgtgatacagtattagtctgagtggagaagattccatgaacatgtcatctagtaccattctaggctctgagaggagcaccatgttcaagatacctacccttggagggtcctcccattctagtgaggaacacccacgacaaacacatgaacaaaatcattccacggagcagatgggtctagtcacggggaaaagtcacttggcggcagcagggaggggcagctttatctggtgacaccagctgagccctcagggcagagaagggggcatctatgcagagatctgggcgtcggctggtgaaagagctcggagcctggaacaagtgggagtattggaggaacagaagggagagacgatgtggccaggctacagccaacagaaggccagtgaggaggggagaagtcggggtccgatcaggtcatgccttaataggtcctggtaagaactctggcttttactctaattgcagtgggaaagcaccggtgcgcattaagcaggggagggacaagatctggtttatgcttttggaagacacccttgactgccgcatagagagtggacaggagcaggacaaggctgctacttaacctccgcaagaagcccagatgagagacatggacaagcgtggcccaactaggtgcagaggtggaggcagtgacagacgcagtcctgtttagaagaaggctctagaactgtgtgggaaagctcaggtgccgtggagcacagctgaggagtggcggtagtgtggcactcagggctttgcaaagctccagggtgtgaagcggtgactgatgacagagaccatgaatgccagggcgctggacacccattttgatttttaaataggctaatacggcatcttgtaacatccctgcgagtcaaagcccagggccccaggagttcccagctgtgtgagcaatgcagaccaggggccaaagcgcagcccagtgccaggaagagccctggatttgtctttgaccaatccctaatcagtggctgatgcctaaaacaccaccatttgagatttctttggagtttaggtctttagctgggaagaaaacgcaaattcccttcccaaaggcaaaacagaaggtggtgagggagactggacctgaagttagcagtgtgaccgtgaacttgagggcagtcagacggagaggccggtcaggacagaagattcggatttccgatttagaaacagctttcgggctgtggaactggaaataatcaggggtacattagctggtgagcctccaggaaagcaggctttgatggaatgagggaacaggactctgtggcttcgggggatctcaaaaaggaggaggcagcaattagcaccagaaagagcctccagctggcaggaagggagcttggctgcttcccaggtttcctaagcgagctccagcctggcctcgagtgtgtctggtctgcaaatcaccgggcccttgccttgtccttctgcagctgctggtgcagcccagccttgggcagagtgagacactcccttctgggatgaatcctgtggggaccctaaaggcagcttttccaggctcctctgggccatcaacccagttaattggaaaaccatgttcctgaataactaagttactgaaatagtttcaatagcttctgaaagcacaatcaaacctaattttcttactgagtttcttttttttgagacagggtctcactctgtcgcctaggctggagtgcagtggtgcaatctcagatcactacagcccgggttcaagtgatcctcccacctcagcctcccaaatagctaggactacaggtcttactttttaaaaataaacttaattttgcttatgttttagttcactattttttaaaaaaaatctcaacttgaaggcattgaaaagaacatcgttattccag

SEQ ID NO: 2074 - DNA, 1100 bp, artificial
  synthetic oligo
cactgtccttgcgtagcaggaagaggccctggtccctgtcctccggggacgaggccaagccccggtcttccaaggctgagctctcgtctggaacactgtggacaaacacgtgtgacaatctctgtgcgtgccggggcactgtccctgggagtgtgtcatgttaggacgccctggagaagggctgagaggtaactgcgatgcagtccctgtgctcaagaagatgaaattgccggaggaaggacagacatgcagtgttctgtcaacccccacagcaggagggagagcagaaggagggggaggcggggtaaaggagcctcccaggagacagggaggagggagggagggagggaagggggcaagcacagaaggagaggtgagggagggaaggtgagggggacaggggaaggaggaagagagaggaaggaaaaggaggaagggaggaggaggggccaggaggaggagggggccggaagatgcagggacagagggggcaagggtgagggggagagagagggggaagaggagagaggggaagtgtcgaaggagaggggagagagaagggaagaggagaggtgggggagggcacatgtggggaatgaaaggacagggagggaggggaagggacagcaagtgaacgaagcaccctccttgccgggatggggcggctcagctgccctactgccctgcagaagggaagtaaaacccctcagtggccatctggttgggaccagggaggtgccctgtggcggaggactaccagcaccctttcgggcccgcggcagacagacagaatacgggtgtacctgaggaggtggccaaggtggtgcctgggcgcccgggtcctctcaaagagtgcgtcaggctgggcgtcggagtctggggagacagagccgtgctcgctgctgctggtggccatgggctctccctgtgtgggcagggccaggacgacaccgcggggaccttctgtagggggacagccagacaccgaatggggagactcagagagggacggggtggagctgagtccctggcagcccctcaagcccaggtgaaccgcccaggcacccaggatcctgtagaaatgtgggttgggcggggga

SEQ ID NO: 2075 - DNA, 1450 bp, artificial
  synthetic oligo
tggattagggcccacattccagaacccattttcatttgattttctttgtaaagaccctatttccaaagaaggtcacattctgaggtactgggggttaggacttccatatatcatttttgggtgacacagttaaatctgtaacagtcccttcaggggaaagagagtgtcctttgtttcagacactgcccagaagtttcttgaaagttttctaaaggaatgaaggatcccagaaataacacaggggccattacttatttaataataactttctcattggcaatgaaaagtgacttcatatgccatccaaaaaagtcagtacattttcaaacccttcatacaggcggggcacggtggctctcgcctgttatcccagcactttgggacgcggaggcaggtggatcactggagtttgagaccagtctggccaacatggtgaaaccccatctctactaaaaatacaaaatagccaggcatggtggcccatgcctacaatcccagctacttgggaggctgaggcaggagaatcgcttgaacccgggaggcagaggctgcagtgagccaagattgtgccactgtactccagtctgggcgacagagtgagactctgtcaaaaaaaaaaagagagactttgtacagtgaattcgctaaacaaaaacaagaggaggcggggagccaggcatgccctgcggaggaatcgagccagtcacagccttcagctctctccctggtttcccggaagtcagcagcaggtcaaaaagcagccagccatggctctcaggtgggcctcatgttttcctcgtcaccagctgctgtttattccaacgctgccatggaagctgcaggttagatctacaacggccccaacagggtccaccgcacacggtcaaagtgctgaggacggtcattgctgtcttccagcccaggagctgagggtcctcttgggattgcaggtatcagaagactcttgtcgacttgaggtcttggcctgggctctgaacccaagcagctgataggaggtgagaagctctgagacccttctgcaggggcctcgccgggctggagagagcagccaaggcacccaagcaggcagcactcgggacccattgaacatgctgccctcacctcaaccggcagaaacctgcactcacacctccaagttccttctgcccaagagggaagcagagagcctggcacagacacaggccatgaaggcaccgtgtttggcagagaagccaggaagacgcctctggaatcgcgttctatcagggccgtgtccacacactgcggcctcatcatccataagcaatggccatttggccttttgtgaccctgctgtctcaaggcagtgccccatggaaggtcagtgctggtaatggcatcctagggctagagctctgcattagtctgttctcatgctgctatgaagaaatacctgagactgggtaattta

SEQ ID NO: 2076 - DNA, 1250 bp, artificial
  synthetic oligo
caaatggcagatggagtcttgtcccatgcataaataatatggttgcttcttttttttttttgagacagagtcttgctctgtcgcccaggctggagtgcagtggcgtgatctcggctcaccgcgaactccgcctcccgggttcaagcgattctcacgccatagccacccaagtagttgggattagaggcacacaccaccatgcccggctaatttttgtatttttagtagagacgaggttttaccatgtgggccaggctggtctctctgacctcaggtgatgtgcctgcctcagcttcccaaagtgctgggattataggcgtgagccactgctcctggcctgactgcatatttctttgagcagaggcatgcaacatgccttcctttaatactaaccacgtggagagaggactgcctggcccatcaaaggacaaatggcgcaattcagtcagcacatattagtacatgccaaatacagggaagccagaacgtgagaaacacagcctgatggtagggaggtgcctagtggaggagacaaagacagaatgctggcagcggtggcagtaatggcaaaatgtggtaggtgctaggacagagaaatacacagaaggctgcaagagcattaataaaatagggtttgactctctgcctggttcgggtcaggaaacactatggctgtgtccatttgggcctctgaggagtaaaatgccaagacgagatgagacatatgagagatttattggggagaaggtctctgaaggacaaagcgggagggagcagggtgggcagggccggctgcggaccacatggcaggtgcaacacctgggagcggagaggaaggcagaatcaggaagaatctgggatgggagagcagcccggagagggcttcagccaggctgctggggagtctgcagccccaagtcatccactggaggagtcccacctgggttctagcacccctgccaggctcaggccttggtggggagcagcctgggtaaagtgtaactttgctgggttggtagccggggctgtcagggaagcagggtcctgctgcgaaggctggagggctggacaaaggggatcatgggtgtgagatagacagcggtccggggaacaagcgatgtctgacacggggcagggtgtgggaatagttaaggaggcaatggcaagggcacaggcccagtggcaagcagggtgggcccagggctctggctttggacgtgctcttgtgggagacagcacacggggaggtc

SEQ ID NO: 2077 - DNA, 1100 bp, artificial
  synthetic oligo
tcaggagacttcagtacataaatgggacagaaggaagtagaattccatcccacttcttttccgtttgtggcaagaaacttttgccccatattaactggcatacaacttcacgttcctccatcattagggaaactctgcttgggaagtatgggaggtattgactccagcaaaacgattactggtggtccatggaacatcgacccagatcagaaggagtcacccagaaggttacagctcaaagtcccagcaggtaatgaagaacatacactttcttgcctggccttgccttgccttctggcccactgcctcaatggctgagtggggcctggggccggccggttgaggcatagggagatttctagctgtcctccttagaaacacaacccacaggcgtgattagaagtcatcttgctacctgggcgattttcaggcaagcattttacaaattgacatttacatttaatttcagaattaaaattctgaaaatgttaatacttactgtgtttttttgagttaccatgtcctgaaaagaaaaagaaaagatgaatatagctttttgtaaaacagctaatttccataagcattagccagcactcccctctataaaagaaattaatcatgtaagaattaatcacataaaagcacccaccttagagcaagaattaatcatgtgaaacctccctctccaaaagcttcaaacacaatgaacctctgaattgcaacattgatattccaaagaaaattgatcaccactggttagtctctggaactattagggggcatttataaggatttccccagaacagggccaatgcttttgcccaaaagatattttgagcttcaagtttggggtgctgagtgccctgcatcttgccttcccagaaaagaatgtcggcgatagcaagaaagggcccagaaggcaccgtgctatccccggatctggaaccacttcctgaatcaatcaatgtgaaggccacaccacagtcagccttcctacagaaggggtgttggtagtagaattcctgacaccctgctacaactgtctaggaatgttcaaattcaatgacaacaattctagtcagtaaatttagtatgataat

SEQ ID NO: 2078 - DNA, 2650 bp, artificial
  synthetic oligo
tttaaagagaaagaaattactctcctctgaaagccgcacttggcagcaagattactggctggtgagaagcagcgtgagcccggacgctgcagctggagtggcaatgcctggcttccaatgagagctgcttacagtgactacatgtccatgcatgcaatcgtccatctatccatccattcacctggtcaggtaaatcctggcgaagatctgggttcacacagaacacaataccctttctccagaggaccactgacacaagactatttgaattaacattcctacctccactaacttggcagaagaaaacaagtgcataaaccaatatacaggttggttgttcaatgtaatcgcttagcaaaaaaatataaagtgcattaagtaccaaggaacaataagcctttctctgacttttaaaagtgtttttgtgtggcaatccatggcataataggttacttagaatgtaagacacgcatactaaatgtactaaatgtactaaatgtactaaatgtacggaggctgggaaggacgacaggagaggcaaaattgaacaaaatataagcactggcacctccccctcttttaaggaaccatggcattcaacaagtgtttgttaaatgagccactaccatatgctcgacaccgtaaggcatgtggagatgacaaaacacactcttgatctgctttaaatctggtaaagaagtccgggggtgtttgcatcccaagtagcacagcatggggcccagcactaggctaaacacgggtggcaggcatttggaggagagagcaatcatgagatctaagggaaggcttccagaggagggcatgctaacaggggctctcaaatctgaagcacgagcaggcgcttgagaggcagccaggcaaggaggggcgagcaccgtcaacaacttggaagaatctagagcaatgggtgtcacggtgtggattccaccaccactaccagcagcagcagcagcagcagcagcagcagcttttaaaaatgtaaattctcaggcccacccaagacctactgagtcagcaactgtggggatagcacccagccatctgctttgaacaagttctccaggtgattcggaggcatgctgaagtttgagaaccactgagttagagcaggcactgccctcccttaaaccggctaagcaggaatctcagggctttcctcccccacaccctcctgcaaaccagtgtctagggagctaggcagccatggagtgtgtggagggctgggggctgaccaccctctcccaggctgctcagatggcacgcactgttaagaacaattacatcttccactggcttcacgaacctctctcatgcatctcccttcatggcctggacttctaactaaccactggatactgggagacgcagaggcagagaagagataagcagaggaaggaggcaaatgggacctctgtgagcccagaagtttggtggtgatgccacatttcccccaggcttgcaaagcctgtacctatcctataaccagagagttgcaagcaactctagaaggcaaagcagcagttggaattccacttctcttcaatcagattgttagaaagagcagcaggaatattttggaaattgttatagagctaacggaaatgtttgtagcccctggagactaatagaatttgccagggtgtggcttcagtgatgtgcaacctttgctgctccacatcttccccatttgtatagctcgtattcttttcggaagcactttggtttaaataagttttttcttctgatatactagcttctgggctgaccacaccactgaaatgatccttgctaaggtcatcaaggctgtcaagtggccccaatatgtgcatgtgcaaagaaccttctattgccagttcatagtagagggtggaacatggagaggcctcaccaactcaacagggggtgtcacatggaggcaattgttggactggaccttgggagatgcctgtagaatgacacaggtgaaccagctgctacttgaatgggctcacacgcacctgagatgaccacagctctgtatcgactgggcagccagcccacgttgcgacttgcctctacatttgagcctgggagttgtgtttttgttgttgtcattgttatgaaaagcaaatgagccatactacaatacagatgaatgttgaagacatcatgctaagtgaaataagccagtcataaaaggatgaatccaccgggcacggtggctcacacctgtaatcccagcactttgggaggcccgaggcgggtgaatcacccgaggtcgggagtttgagaccagcctgaccaacatggagaaacccagtctctactaaaaatacaaaattagccaggcgtggtggcacatgcctgtagtcccagctactcgggaggctggggcaggtgaatcccttgaacccaggaggaggaggttgcggtgagccgagattgcgccattgcactccagccagggcaacaagagcgaaactctgcctcaaaaaaaaaaaaaaaaaaaagatgaatcctgtatgattccacttactgaggtacctggagtagtcaaatccatagagacagaaagtagaatggcggctgccaggggctgggagagggggtaaatggggagtcactgtttaaagggtgcagaatttcagat

SEQ ID NO: 2079 - DNA, 1050 bp, artificial
  synthetic oligo
gtcccatttgctggagttttatcatatgtctcacatttgtcctccgagtccaattccacttctaccgcctgacccagggctcatccagcctactgtaaacctcctcacttgggcaacgcttcctgcccagtatatatataatatacacaccactgtcaaatataaaattccttgaataaaatccctgtaatcagttaatctccatcccacttcaggcatcctgaccctgagcctgctttttgtcctatagcagactcccaagtctcgtgatcaacaacttccagctgaagcccaaaatgagaaaaggctttccaaaaaacaaacaaacaaaaaaacctgctgataacacataagggaaagcaagaaggtgacagagaaagagaggagatcatgttcagggcccatggagaacccatggtctccacgacaccagtgggattagaaaagggctcaagtaccagatgtgcagctggcctaaggccttgctgtagggccctgggagagccatggcttgtatggctcatttgtaccttgttagatcatacattccagcaaggtgaggagcacatctgacttttcaccattatacccccagccatgtacacaatgcctcatataataagtatttgtagaatcaatgcagactctttctagccctgagagttctgcgatctcctccagtccaatacttgaattactgtagaacaggatggcctctatctgcctaaactcgtgggaattctctataagttagcataaggcccacctcaggtagcaagtaattcatcaccaccttccactgccccagtggtatctgttacaaagataagctgaccccttagggtcttccttagggaagagagtgcagattttggaaatcagtccttagtcacagactataaattctagccccaactaacaacaaaaaaaaccaaagacccttgaagtatcaagttcagatttacccagaacaaaacaagggtccaaaagtctttcaacatgaaaggatgcttatctttctggaaaaatgacattgagaagtccaagtag

SEQ ID NO: 2080 - DNA, 1150 bp, artificial
  synthetic oligo
cacactcagttaaagtttcaaatagctgtaaaggtctcttatggaaaaaaagcattcttcattctccccaacttcccctccccagaggcaactacagccttcgaaaggaacctcatggccctcaaaaggaaccaaccccaccaacaccttgatcacagacttccagcctcccggaccgtgagacaacacatttctgttgttgaaggtgcccaatccatggtactttgttctggcagccctacaaaactaacacaagtatttacatccttatgactacacaaacattactaaaagcctagccacatggtacactaagattatgtttctttcctatcactagtttcttttcccctagagctaatactagtctttttttttttttttttttttttttttttttttttgcttagtggagagttcacttaaaaatggattcaactccaaactcatcctccctggtctaaatcatctctcaagaggtccatatgcatcagatggtctgtccatttcatcctctctcagagctttccaacctaaggactggaggcggggagggcagggtgaaagctggggtgctctaatcaattggcaagatgggctctgtccttgatacaagctcaaaagactgcattatccgcaagtctggggagtaactggaggtttgggagcagagaggaagtataactataaatatgtgttctctgatgacacctgcggcagaaggactcatgggcagaggctgcaggtggcaggaacacactagttagacagcaaacatggtaaatcaagtaggggaatgggaacttgagatgaggcaggggaatagaagcaaggagcttgattaagagacattcctgtggctgggcccagtggctcacacctgtaatctcagcactttgggaggccaagatgggtggatcgcttgaggtcaggagtttgagaccagcgtggccaagatggtgaaaccccatctctttaaaaatacacaaattagccaggtatggtggcatgcgcctataatcccagatactcgggaggctgaagcaggagaatcgcttgaacctgggaggcggaggttgcagtgaactgagattgtgtcactgcattccagcctggacgacagagcaagattctgttaaaaaaacaaaca

SEQ ID NO: 2081 - DNA, 1750 bp, artificial
  synthetic oligo
tttaactttgcctgtcaacaacggactgggttaaacctcctcttttccaatccttcaggctttctgaacatcctgactagtgtactggaatcctattacctgaacacagaaaggtctcactttattatgatttattattatctgcagccttcctatgcctggcctaggaacatccaaaaataatctgccagaggctgaaaaacagaagctggctgtcagcaagaacattacctgggtagaccaaacatttaatagcccaagtaatcataagtgccttgccaataaagtggcagcttctctgggcagcaaggtggttccaatgctccggggtctaaatcaaatgggacccagggggttcaaaggttagttggctacttcgaactgatgtttactcagtaaatcaaagaccggatcaccatttccaggtcccagaccctgaagacttaaaggacagtatgggaagtggccttttagcatcacggagcagagagctcgccaggctggaggaaggcagcagcgaaagggtcggggccgggaggaaggggggcgcaaggagaggagcgtcaggtgctctggaccccgggactgcgagccagaccaggaactggggcgtttcccgccccaccccccaacccctgtcaacccccagcaaaggcaacccagccccctccaagaccccgaggttccagcttcccccgagacaggaccaggaagacaccagcagccccgcgcagggccggagcccaccaggtccgggtgcccgtgtccgcagcgcagaggagggcgcgctcgggtgcaaaaatggccaagacaaaactctccccgcccacccgaaaaaccaaccacaccccctgcatccctcagcccgagccgcccggggccagcccccgtgatcgtctgctcaggcccccgcgggttcccgtcggcgccgcgcgcgggctcggcgggcacacgggcgcaagtgggagtgaatgggggtgcgcgaggcaggcgagggcgcccaccgcggtgtcccccgtccggaccctgcccccggggcgccctcccgggctccgcggttctgggactggcgcgccgccctcaaggctgaagtggacgcccggacgcgggcggcccccactcacccattggcgtcgagccgggccgggccgccgaggcagcgtgaaagttggcggaggcgggcgtgggggttggggcgccgggatcggggcgctgggatccaggcgcgagggtccggacgcggcggcggctgggccggcttcttcctcagtggcggcggcggcggctcagcgccgcccgctgctgcctctgctgctgctgccgctgctgccccggggcgactcctgctgctgctgttgcatcgcggcccaatgcgcccggctgcgccgggtttcctgctccccgcgagtggaaattgcgaaaaaaaaaaaaaaaaaaaaaaaaaaaaaaaaaaaaaaaaaaaaaaaaacagcgccgcccagcccagcgcccggcagccgcggccgcgccgcccgctctcccctcctcctcagcgctgccgcgaggctcctgcagctccgcctgccggggacgcgcggccgccgggcgggggcggggccggagaggggcggggccggggccggggccgcgtcggggcaggcgccgggggcgtccctgcggctgaggggcttgggcgccctcctcaccgcccgcgccagaggcacccctctccgcgcggctgccacccacccgcagcggctgggctgacgcc

SEQ ID NO: 2082 - DNA, 1700 bp, artificial
  synthetic oligo
aaatacatataaaaaataaagctggggccctagagtcacagccagctttgccaagttccagctgtgtgtgtccttggggaagtaaccgtcccatacctacctcaaagcatgaaattttttttttttttttttttttttttttttttttttgagacggagtctcgttctgtcgcccaggctggagtgcagtggcccgatctcggctcactgcaagctccgcctccctggttcacgccattctcctgcctcagcctcccgagtagctgggactacaggcacccgccaccgcgcccggctaattttttgtatttttagtagagacggggtttcaccgtgttagccgggatggtctcgatctcctgacctcgtgatccgcccgcctcggcctcccaaagtgctgggattacaggcgtgagccactgcgcccggccaaagcatgaaatttttgaagcaactcagtacatgctgtctgtcatggcccactgccgcagaagcctaaagcaaggtaagcagaggcctgctgctccccacttcctgagagcctggcacatcgcgggggtgcctggcagctcaggatctttacaggatgctcccaagccttgcatctaaatttcatccctgacttaaacattgatccatgagtggtaccctcaccttggataccttggatctctttgctgtctttatcatttcctcactgtgacttctgggcccctgtccctaccacatcagagattctaaactcaattgacagccaagcgcagtggttcacgcctgtaatcccagcactttgggaggccaaggcgggcagatcacttgaggtcaggggttcgagaccagcctggccaacatggtgaaacccccatctctagtaaaaatacaaaaattagccgggcatggtggtgggcgcctgtaatcccagctacctgggaggctgaagcaggagaatcgcttgaacctgtggaggaggttgcattgagctaagagcatgccactgcaccccagcctcagggacagagtgagacactcagaaaaaaaaccccaaaaaacaaaaaaccctcaaagttgacactcaggatacctgctacctctctacaagtacaatggcccacgcccagccccaccatgcattcaattcttaccgatcttgggtatttctgatctctatagctattccaaattctatttctctatcagaataccatttcagttatggaagttttatcatgtattttactatttgttgggggaaattcttctttaaaaattcctaggtttcttagctttgtgttcagcttttaaaatgaactgtacaattctattattatttttgagatggagtctcgctctgtcaccccggctggagggcagtggcgctatctcggttcactgccagctccgcctcccgggttcatgccattctcctgcctcggctgcctgagtagctgggactacaggcgcccgccaccacgcccagctaattttttgtatttttagtagagacgggttttcaccatgttagccagtatgggcttgatctcctgacttcgtgatccacctgcctcggcctcccaaagtgctgggattacaggcgtgagccaccgcgcccggtccctgcaattctcttttcaagttgctgaaatgaaatctcattgactggaaccaatgtgagtgctgcctataggatgagccttcttcat

SEQ ID NO: 2083 - DNA, 1300 bp, artificial
  synthetic oligo
tctggaaagagggccaagacacggggataaatgactcttgcttagaagcttgttgctttttctcagcaacaaagcacaagaaatgtacaaatatctcttttaaactgtggacagaacccagcaggtaatgactggtaaagagaaattacctgtggagtttccagtattagcaatgtcatttgatttctattcatggtgatgtgtatgtgtgtttaataacatgaaagtaaaagatgtaaaagagtctcatccttcctatagggagatagctaaaaagaaaaagaaagaaaaaaggatcccaaaggctcaccagagacctttccagccaatctccatggcactcctggcccagatgcccataaggccccaggtccctaccataggacaagctgcactcttgagtatgagcaagccaactgcaagctctttgtctcaagctgattatattgtcctcattccttgtttctgtttctgcacaattacatgtatgtggttgtttggggtccctccaacctcactgttacagggttaacaggacccttcagaccccttccctgaggacagccccttcttcctaggctgacaactcttccttggccatctcactgggcatcagatctgattttttttttttttttgagacagagtctcactcggtcgcctaggctggaatgcagtggcacgatcctagctcactgtaacctctgcctcctgggatcaagggattcttgtgcttcagcctcctgagtagctgggattacaggtgtgcaccaccacgctcagctttttgtatttttagtagaggcgaagtttcaccatgttggccaggctggtctcaaacttctgaccttaggtgatcagcccgcctcagactcccaaagtactgggattacaggcataacccaccgcgcccggcccagatctgagctttaatcactgctgagcacaaactacccaatgtgaactgcttgctctcctagccctgctattccaacttagctcatggcaattccagcccacagaagagatggtcccagttacaccactgagtccagaggccactgacaaggctactgaagagcaatgcaagtcatcagggtagtgcttaggcctgctcctaccaccagctggcttccgtttcaagaagattccttagttttaaaacaaaatgcaaaggataaataaaggggctaggaaaaaaaatcactcttttgggctgggagcagtggctcatgcctgtattcccagtgcttaggaagaaagtgggagcatcgtttgaggccaggagttcaagaccagc

SEQ ID NO: 2084 - DNA, 5450 bp, artificial
  synthetic oligo
ctgtgattaggtacctggacaatgagagaccatcttggacatttcgagcccaactgagctcccagcagaccagcagactgtaccagcatgagggactccaggtgaccccaaatggagcagcagaacttctccaataagcccaggcaacccccagaactatgagggttggcacataagtgctcaacaattagcggccattactgtctgggaagctaaaatgaacatgtgcagtatataactgcagaccgctgtgtacattacattcaggttctgagcgctttgcaggccctgtggagtgggaatgtacaggaggtgaaaaggcaaggcttcagggtaaaagcgcgtcttagacctgaaggacagagtatgcagaatattggtttctaaacctctaatgcatgaagacccacccacagacttctaggcaattgcaacgcgtgtctgcaccaaaggctgaagactgtcccggcagaagtctcgtggtctctatatagacagatgggtagttgtgaggccgggggaatgaagaatgtcagtgagtatggggattctttgtggggtggtgaacatgttctaaaattgattgtggtgatggctgcacaactctgtgaatatactaaaaaccatcgaattgtgcattttaaatgggtggactatatggcatatgaattttatacagatgataaagctgtttatttttatttttgagtcaggctctcactttgtcacccaggctggagtgcagtggcacaatctcagttcactgcagcctcgacctcatgggcttaagcaatcttcccgcctcagcccctaaagtagctgggactacaggtacgtgccatcacgcccagctaatttttcgtattttttgtggagacagggttttgccatgttgcccaggctggtcttgaactcctgagtgcaagcgatctgtgggcctcagcctcctgaagtgctaggattacaggtgtgaaccaccacgaccagccataaagctgttattacagaaacacagagggtgggacggatgaagcgggtgagatgacaaaggagcaaggaacattccaaagggttgcctgggggctacaaggcaccaacctatttggcactgagaggaaaagccaagtctttttaggtggtgaacgaacccagcactggtcagaagctaggagccctggggacagaccctgtcattccaaggatctcaggcatttggcatcactgctgttgcctcaaatgctttgcatgcatgcggctcactcatacctgttttcctttcgcttaaatgacaacccaaactctgctagtcacaaggcttttaaaaacagaaaaagttcctaggcaagaggaaaacaaatgcttcccaacagaaaagcagatgggggcttgcattcagactgacctcagaggcagacgaggcgggatcccaaggcctagtcagacccagagcctcagatgccaagacggtaaactccatatttaaatgcggccgactcagatgtgaggtggacagtggacactccctccctaagggcggctgccctctactaccccctcttccttcttctggtgaaattcctttcaaaagggaccggagggcagggccatgggaagttttcaaatcttggaactgccgcctgagccaacttagcacatgaacagccccctaaaaccaggcagtatcattgtatcaccagccaatatatctcatcaaatcctctcaacaagacccaccaggatatttaccaacagcccccagaaatctccatctctcgcctgcccaaatcaaccttgtgaatccttctgttttgtaaggcaatcaatgtaattacaagaagacaaagtgttcttttaaaacactagccactgcagaagatggggcacctgagaggaaaacatcctttcatgttggagaggaagcaggttagaaatgacagactttgagcagctatgtcaccatggctaggatatgagaagagaaatcacaaagactttcagcagtttgtcctgaaggtcctgctaagtctaagtcctatgctgccatcagtaaaaaaagccaggagccacaaaccaaatacaactttgtaggaagtttgtggtccttcctactaccaaagagactctagaggcacaaactcaacttgttctcttgttcttcttgatctgaacacttttttttttaagatcggagtctcactctgtcgcccggggtggagtgcagtggctcaatctctgctcactgcaacctccgcctcccgggttcaagcaattccctgcctcagcctcccgagtagctgggattacaggtgcctgccaccatacctggctaatttttgtatttttagtagagacagggtttcaccatcttggccggcctggtcttgaactcctgacctcgtgatccgcccgcctcggcctcccaaagtgctgggattacaggcgtgagccaccacgcccagcgatctgaacagttttaggattaaagcgttcaagaatggttttaaacacaactttgaaaaaggatgaagaactccgatttcttggggacccaatgcctttgctactcgggcccactctacttttttttttattttacaatttttaatttttgtggctacatagtaggtagtaggtgcatatatttctggggtacatgagatgttttggtacaggcatgcaatatgaaataatcatatcatgcaaaacaggttagccatccccctcaagcatttatcctttgtgttacaaacaatccagtcatactagtagttatttttaaatgaacaattaaattattattgactataattaccctgttgtgctatcaaataccaggccttattaattcattctatttttttatacccattaaccattcctacctccttcccaccccccagtacccttcgcagtctccaataaccacctactctctatctccaggccccaccctattttgtttttctttcgagacggagtctcgctctgtcacccaggctggagtacagtggcgcgaggtcagctcactgcaacctccgcttcctgggttcaagcgatcctatgcctcagcctcccaagtagctacgattacaagcatgcgccaccaggcccggctaatgttcgtatttttagtagagatagggtttcaccatgttagccagactggtctcaaactcctgacctcaagtgatccacctgcctcggcctcccaaagtgctgggatcctgggcatggtggcgcagaagttgcagtgagctaagattgtgccactgcactccagcatggacaacagagtgagacttcatctaaaaagaaagaaaggaaatatggttgagatctggtgattctatctgctggttaaaggttgttaagcagattgaaacaagcacttgctcatttgttatactatgtgtatcagacaagcactaaaatggacagtagatctggtaatttctattcagaggtaattaaaaggaaagaaagaaggcatcactagggggtaatgggaacatgcacaggatttcaatatcggaagaacctgttgctagaggaaaccaccagcggtatttcctttccgtcttttacacagctcccaggaaaaccacttgccaactcatatcccctaagtgtgcaacacaaaattgttggacagcctaaacatctcaggtctttctgtattttgcagccttgacagcacccagcccaagcttaggaacaatggttgactctctagaaaagcaggttaagtctcattaggaatgggtcccaaatgctaagggcctgggtaaccaagaatgatcagtatccaggacagataattataaaacctcaaaatcataatttttctaaggagactttacttaagtacctggccttgctaactcccccaaacaacaaatggtggtatcacctggcacctaaattaaacattccaattttaccataccaaccttaatgcacataggtgcttatttcacattttaaaccttcacacatatttttctatatttccaatttcaaatgaaggaagatatccttaagctaatcttaatatcagaagagtgcattaaatgattctacaatagtttccaaacagaacttattaagaatctcccccgcaaaagtacctcctccccttccccaattttgtttccattaaaaaaaaaaaaaaaaaaaccccttaagttccttcaaataaaatccaagatacactgaaaacccaatcataccgcccctccccacctctcatgagtacaacagaacatcgaaacaaactattatttaagctctcaaccaaataaaaatgcaaactgaaacaacctctccttttcagtgttttattatacaaggtcgcctctgccacggagggtcgttctggtgggtagtttccaggttcttccctagcagatgcagcttgagtgtttcaagcaaaaaggataaaaacaaaagcacacatttcaaaggtagttataacgttatcctgtgacagttaatgaattctgcctttaaaatagcataatgaaaaatacaaactggaaatgatttaagctatctcctcctcctaagaatgatgcaactgaaggcccagtcagaaaatactacctcgccccctcaaccccagtgaaaaagcgtgttttaagaagatttctcttgatttctttccttttcttggcccatcgtatataaaatactcccatcttcactatgtgataattcatcgaattatagttttgtgtggttttttaaatgcatattagactgcaataaaaaatgttttaaaaatagcctgccttattaactaaaaataaaaaagttgttgtcaggaaaaacagcatgaaatcggtttccatgctgcttacacccccgcactacctgcaaccactttacagaacgttagcatcagacctgcttatctaaaatcctgccaaatgtcctcacagtctcctccgctgcctcgctggcttctgggcagccagggaccagccctccatggctcccagcatcggcagcctcgagggctgagagccttgtttgccccgctgcctcgattgagggccgcggcccggccacctgagcagcgttcccaagacagggagcgcatccgggcgggaggagcacccggtccggggcagacgcctggccgcccgggcgaatctgcctctgccaatgggtgacacgccgattttgccccctggaaacgccaagaggcgcgaagctgggccaccttcgccgcgggctgcagcggcgctcgcgcgcgtttcccagaacgcagagagagcgcgcgcggaggccggggcaaccccagaaccccgctcggtttatcctaacgacccccatgccggctgctcctcgaggacggggactggacccgcagcaccccctcaggcacctccatcccaaacacacctgccgcccaccctaagccaccccccatgtgtacccactcaccc

SEQ ID NO: 2085 - DNA, 1000 bp, artificial
  synthetic oligo
tcgcgtgtggggcgcccagccgcgggcaggcagggcgggaaggaaaaagggtcactgcggcctgggtgacctgcaatctacgggcaggacctgggagacccggccgagcagagccgtggtccgggggtccgggcggcattacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcagagatccgcctgcgtccacgctcggcggcagcaaatggcgccgcgactctttgcgtcgcttttccccgcctcccgtcgccggctgggcccgcccccaggctttatgacgcaggcgtggccgactgactcctattgttagagccgagggagacgcgttgtgggagggtgcgcagcaagccagagaggacgcgaggggcagggcctcaagcagggaaaaggcggagtcagggagggagggggagagactctgcgtcatagaaaagggcgggttgaggtggcgcttgctgctggttaagaccagacctctgctgctttgtagcaaacgcgcgtctcccggtttcacaagtggctgactcgttaacctcgtggttagctcagtttttaaaaaatatgtatatttttatttttattttattttttgagacggagtcttgctctagagtcgcccaggctggagtgcagtggcgcgatctcggctcactgcaacctctgccgcccgggttcaagcgattctcctgcctcggcctccggagtagccgggattacaggcacgtgccgccacgcccgtctaatttttgtgtttttagtagagacggggtttcagcatcttggctaggctggtcttgaactcctgaccacgtgatccatccgtctcggcctcccaaagtgctgggattacaggc

SEQ ID NO: 2086 - DNA, 1150 bp, artificial
  synthetic oligo
ccttaataatttttaagagtatgaaaggattctgagaccagagttttagaactactgatttagagctctgttgttccaaattgtttggaccagcagaacccaaatcatttgggatcttgttagaaatgcagagccccctcccagacccactgaatcagacctgcattttaataagatccccaggtgatccataggcataagaaagactgagatgtactatcttagagggacctgcaggcctctaagtgcacctctaggtgtctgatgggggagatcgggttcagcctcttttcctccctctccctcagctactaccattggggtatgctccaagcctcttgctgctgtggggagccctttgtctggtgggtagcccttttgagcggaatgccagcacagatgcttaagcataggtaccttcttcctcaatgtctccttggcctgtaggaaatgtactcatttttgccttgccaaactttggcacacaggtatgtccactgccacccctcttcactgtcatttcggggtgggctgttccagcatccaccttgtcctaccttgttctatatttccaggctggaagtaggcactagtttctatgtttgcataagtctccacactgcccagcactccctcatcatgctctgatgtttgcactagggtgagcctgcaggttctgcccctcaacaagcatccagctggagaaggggggccagtccatgctgctgctttttttcacctcctttccccttttctctttctcttcttttgcaacagctattgagatataattaacataccatacagttcacccatttaaagtgtacaactcaatgcctttgaatatattcatggatttttttgcaccatcaccacaatcaattttagaacaatttcatcaccctaaaaagaaaccctgtaccactcagccattatccccgaccttcccctctacccagccttaggaaaccactaatctacttcctatattaatggatttgcctattctaaacatttcatataaatggaatcctatactatgtggtcattcgtgcctggcttctgtcatttagcatagtgctttcaaggttcatccatgttgtagcatgtatcaggacttcattcctttctgcggctgaataatactcca

SEQ ID NO: 2087 - DNA, 1000 bp, artificial
  synthetic oligo
tagttacctgctcctttttatttctggggggtctctctgaagatgcatcaacttcttcagaacccacttattaatttatttggctagaaaatataatcagcagtttaggagaaaacaatgactgtggatacaatgagaatattgtgtgcctctctgactgcactctctagaggtttgacattgttggagtttgcagttactaaaacaaactccgcgaggccttgttccttcatctgtcctctgcctttgtctctagtctgatctattgctacagtcccctttgctctctatttgccagcttactgaactatctttagtgtcctgaatttgccatagtctttgttttagttctgttgtgaacagtagaacccacttgtaccagttagggtaacgttagctgccgtaacagataaatcccaacatctgcatggctttaacacaatagaaacccttatatcactcccatgaagcctgtcttagttcatttgtgctgctatagcagaatacctgagactgggtagttgataaacaacacaaattattttctcacagatctggaggctgagatgtccaagatcaagttgccagcatctgacgaggacctcctcgctgtgtcttcacatggcagaaagcagaaggacaaaaggggattaatgttgtgacctcacatggcagaagagcaaaagagagtgaacccactcccgatatccctttttataatggcattaatctattcacgaggaagacagagccctcgtgatttaaacacctcccaaaaggccccgcctcctaacagtgttgcattggggattaagtttccaatacgtgaatttttggggacacattcagaccatagcaaagctcaaaatgggtgttcttgattcataggtggccttccaagtggtcatttaggacccaggttccttctctcttatggctttgtgcctcagcattctttgcattcagctggaaaaggtgaaagaggctgtaggataatgcc

SEQ ID NO: 2088 - DNA, 1100 bp, artificial
  synthetic oligo
gctgccttgagaggtggctggtaaaggacttcagcctatgtggagctcagagagttctgtgtgggaatgactgtagtggggcatggccagggatgccaatgccccaaggcttgccatgcttctctaggtggctttgggctttgcagactgtgagtcctggacagcacagggcagtcttgcctgtgggatggggccagtctaaactgagcaccccactgcctgccggcctctcccagagtccctgtcaggctgtgcacacttgcagcacagcctcagatgcccaaacggggtgtcttctgggaagccactgccatagatcctttactggcccgaccattggagagcttcagcagatgggccttcaccagtgaatacccacctacaggttcacaccattgctttgatggtgtgcactcacctaaaacctccccccactgctttgccagtgcacatgcccatggaactcgcgaccaccacaccaaccccacaggagcgtgcacacagatgctgctgccccacccatgccggagcacatgtaccccatcatgctgcccatactgctggcaaacaaacaggtgcaatccctgctacccggctgcagccagcatgcacatgtgagggcagatccctcagccaccaccctgatgacacacttttgttggcaccccttattggaatgttgttgctagtggaccaaaaaacaaaaacaaaaacaaaaacaaaacaaaacaaaacaaaaaaaaacactttggcttcgccggtgcaccaggtgcttaatgagaaggtgtcagaaaacaaagccatggtactggaaccagcccccagggttagaactcacagcctaggaatgctaagctgagctttggccccctgatatcatccagaaatgaagacagtcaattgaaccaaacttatacccacagccaaacactgaagggcaccaaagattctaaaagaaaaaaaaaaaaccctatccaaaggacagcaacttcaacaattaaagaaatatcagctcacacaaatgagaaacaacccgtgcaagaactttggcaactcaaaaagccagaatgtgttcttactttgaaatgatcacactaact

SEQ ID NO: 2089 - DNA, 1000 bp, artificial
  synthetic oligo
caactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcata

SEQ ID NO: 2090 - DNA, 1150 bp, artificial
  synthetic oligo
gggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggt

SEQ ID NO: 2091 - DNA, 1100 bp, artificial
  synthetic oligo
tccatgggccaaatctacttgctgcctacttttgtaaataaagttttattggaacacagccatgctcatttatgcattgtctaggtctgtgtttgtactacagtggcagagttgggtggttttaacagaaatgtacagcctgaaaagcttaaaatatttactatctgaccatttacagaaaaaaaatttaccaaccataggcctagacaattaattatatataattagtccctgaaaaatgactaaggaacaagcaatacagagtgtgttgtcttctgtttctttctagaaatttgacatcttgggacctgttgttatttgagggagaaatagtgttttttggtaaagaaaataggaggtagatagaagaaattccaagagcatttcagaaggggagttatatttagaagcattgttcttccacagtcaatcaaggtaatgaaagggagaattgcctgaggtgaaggtgtgaactagggcataacattctagaagtgtttgtaagaagctgattggtacccaatatattaaatagtgaatttactaatgccaatcaaacccaaacttttttgtttaaaaatgatttaaattattacagtctatttatgtttgcttttagtaaggaaaagagtagtagtagattttattacaggagtaaattctgaatcttgggacatggattcaactaaagtagaagttacttttgattggtgtttgcacaaattgttttgcaccagctattataaaaaccaacttttaatatcccatattttgagatttatggaggtgactttccttttctttggagatgatgaatgtgtgccgactggtattgctgtttgattatagatggctagctgtgaggaatgtggaaatgatctcagccatttaaacctcaaggcaatctccccatgtgacctaaaaggtgtgcattttatttatgtagctattttacctactcactcagatttctattgcacttagaaattcccaagtgaaatgtctacagttattttgtaaaagtcttgaaataatattcccttccttctcattctcgctcccaggaaatttttgcttaaagcagcatttgtgaaatagca

SEQ ID NO: 2092 - DNA, 1050 bp, artificial
  synthetic oligo
acccaggtattaaacccagtacccaatggttatattttctgcttaatgtaggttcatcatgcaaatagatttctggtgagccacctacaaatttatcgcacctgcctgactccaaacaatgggtatagcttcggtttaaaccacaacctgttacatatctacataaggcaacacataggaaaagacaaagaagatacaccaaaaatggtaaattattacctctgggtgttgggatcataggtgagtcttttcttcctgcttcttgaaacttttctgttttctgaatgcttatagtgagcaggtattgttgttggcctttggggaaaataattaaatgggagtaaatgtagtcatactccttggatataccaatatcccaacagcagccatgttcttgttccttcttccacgaagaaaccaagtagagaataaccattcggtagccaattcttactcatttccatggccagtcacctccaatgagggcaacatttggcagagtatactgttctcccagagaattgggtcatgggtgtggggttcaggaattcaacaaatagaagagctgaaattagatgaagtttagatgagacttggcaacaccaactcctccatgcagaagagttttcatagtctgcagatgctaataaaacttaaaaagtatggcaacaaggaactgatctggagcctaactgagaggcatgcatgcagtatgtgtgctgcaggcatgtctcaataaagaggtaacattattctctactaccaatatttttaaaagtcttctagaactagtgtttgaaaggtgctagccttgaagatcacccataatatttcacacatacttagctaaatattgaacagactaactctctaaaggaatctccagtaattttgacccaaagctgcacatggcggcaggcatttgactccctttgttttacaagcaggggtttcaaggaaaagttctctcttctccacaccccagagagcctatagtttgattcttaccccaaaaggggagatggattgatgaagttcagatttcttact

SEQ ID NO: 2093 - DNA, 1350 bp, artificial
  synthetic oligo
gaaatagaaaaaaataccaaatctgaaaatactgtcaattataagtcctaccaaaatagtaatttctggtttccactaaatatacttcctttgtttgactcatcacttggaattgtggatgttttgacttatttggggcataaagtgattccctggcctttttaaccacacagtatgcacaaccttcccttgctattctctatcttcttcttaaggtttatttttctccataatacctatcataatctgacattacattatatactatatccatttgtttatatccttttgcttccaatataaattccttgaggacaaggagtttgtcttgttttccattataaacctcatagccagaactgtgcctacatataatacatactcaattaatacttgttgaatgaataaattaacaaattgtttttcacttgtaaagagatatcatcatgtatactaaggagatacactaaacatcgtagcattacattacatataatgcatcataaattgcatatagttaaattcctagtgatctttaatttgatatctattcaaaagtctttataattggcctttaaaagtattactactttgagtctacttataattttgtctcatttcaatgtaataatgtccttaagaaatatatttcggcagccgggggagtccgagaggaagcggaggcgcgagctggaggcggcggctcccgtcggcctccggcaggactgagcgctgggaagccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatc

SEQ ID NO: 2094 - DNA, 1800 bp, artificial
  synthetic oligo
attgcctatgtgtacaataaatgatcgacaaaggttgaaaggtagtgtgagtacaccgatacaggtgtttttgtttccttctttttcttgttcttactttccaaattgtctaaaattaatatgtattaattttaaatcagaaaaggtaacaatttattaacgtactggtgaaagctctgatcacaaagtcattggcccaaatgcaaacccaagtcgttggtggaggcaatgctccccagaacttctacaaaaagagaagaaaaatcggggggaggcaacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgtcatttagcacctcggctacgcaatggtgggtggtttcccaaagcgcgtgccctcgcagccactcgcgctcgcctcgccgcttgcaggggcacaagtcaatgaggcttttccctccgcgatcatggtgaatcagcaaagcgctgcagagcagcggcacctccacgagcagaaattaagatgctgggggaacggcacgagtggagtgtggcaggggaatttctagccccttccaatgtgtccctcccagggacggcgatactgggggaggggagtcagctggaagctgctggacttaggcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtcccta

SEQ ID NO: 2095 - DNA, 1000 bp, artificial
  synthetic oligo
gtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgc

SEQ ID NO: 2096 - DNA, 1050 bp, artificial
  synthetic oligo
acagacaggccttgatgggtttccccaagcagtgtattagcattatatcatacccctttcctccaatcatatttctacatggctgtccgtattttgttgaacctaaacataaaaatagacaatttcccctgtatctttgggtcttcattctgaaggctcctgtgtatactcgttaaataaatttatatgccttttctcctattaaccaattgcctcatgtaactgatgttttagcaagccttaagagggccaagagttcctcttgactcctacaccaggaacatgagaacatgagagaaaaggaagaacacagtttttaaaaagatgcagggaatctgaaaacagtatcaataaacatgggtgacctcacaactctaccaagaaacagcactacttaacatgttagaagtattctgcctctcccttagagcaaataggtctttcattattgtttatcttaactgtgttgaggagtttttgtttgttttcagacaaggtctcattctgttgcccaggctggagtgcagtgacacgatctcagctcactgcggccttgacctccttacctcctgggctcaagcaatcctcccacctcagccttcagagtagctagcactacagacgtgcaccaccacatccggttaatttttgtattttttgtagagccagggttttgccatgttgcccaggctggcctcaaactcctgggctcaagtgatcctcctgcctcagcctcccaaagtgctgggattacaggcatgagccaccatgcacgatggaggagttttcttaaggttacaggaccttgagcacttctgaaatttaaaagctataaaaacaatgagaaatgacccatatttattttattctgtatcaccagcctaattcttcaccattttgggttatatagtcagttagcaacagcctattgactatgaatttggtatagagcattgtactatggaataagaatgtacaaaacaattaaaaaagatagaccctgccctcagagagctcataattgcattggaaacacagacatgcaatcag

SEQ ID NO: 2097 - DNA, 1050 bp, artificial
  synthetic oligo
ataaactggaaaactcagcaattctgtcccctaagtaataccagatacacgccagttttccttttcctgggttctttgggaaatgtgatcattttaaatactactataggacttgtattatgtttgcattaattactgtctggcctgttacttattttgcctttagcctagtttttactttccatcctctagtctgggtcatttgaggcaattttttacttccctttatttttgcctactagcccagtgttgctcaattctagatgtgtacacagagcagttgacagagggacacccagatggctctggtgagctgggccaaagtgggtaaatcacaaagaaaggggaaagaagatatgttttaagactgtacggagtctgggcaaaaaagtgagaccctgcctctacaaaaagtggaaaaaatgtgatggcacatgcctgtaatcctagctactcgggaggctgagctggaaggattgcttgagcccaggaggttgaggctgcagtgagctatgatcacgccactggattccagcctggatgacagagaaagatcctgtctcagaaaaatttaaacaagagacctctcagccacacatggacagataaaagactatatcaggagttctctagtttcctcggataaaaatgaagataataaggtatctgtcagcttgttatgagaatttatatatatatatatatatatataaaatttttgtgggtacatagtaggtgtatatatttacggggtaaatgaggtattttggttcaggcatacaatgcataataatcacatcagggtaaatgaagtatcctttacctcaagcatttatcatttttctttgtgttacaagcatcccaattatactctttcagtttatttacaatacctaaaagagtatagcttttttagttatttaaaatgtacaataagctaggcgcggtggctcacacctgtaatcccagcactttggggggctgaggtgggtggatcgcctgaggtcaggagttctacaccagcctgaccaatatggtgaaacccgtctc

SEQ ID NO: 2098 - DNA, 1200 bp, artificial
  synthetic oligo
taatttactttttaaaaagtagaataatggctttatgctaaagtgcagattttcgaaattaagtcttcatcgtaaaagtcgatttttttccaaaggacacgagttcacaaaacgcagggaagggggtccactggcccgtattaaataatgttccctgaggagtggagcaaagctccagcttccctcgtcacccagccatcccaccccagcctcccccataccctgcacagcttctcctaaaatgaccctcccccatccacacatcaggttctgaaacctgaccctgccaggcaactaaagccgcgaaccccacagtgccctgagctggcctcaccctacccacgatcccaagagggtactagccgaggggatgggtactttgggggaaggcactttaaattttcaaagtgtttaattcacgaaagcacaacccaaagggccgcccccacccacccgggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaagg

SEQ ID NO: 2099 - DNA, 1000 bp, artificial
  synthetic oligo
tcaaaacaacatgttgtacaaggttaacagacaatttttatttgtcaattaaaaataataaaataatttaattttatgaaaaatatatgacattactgaagatggtggagaagaagttgctgattaagcaacgtttgctaaaaagtgttttgatagtgtaaggctaaagacaaaaaggaccgtacataggccaggcgaggtggctcacgcctgtaatcccagcactttgggaggctgaggtgggcagatcacctgaggtcaggagttcaagaccagcctggccaatatggtgaaaccccatctctactaaaaatataaaaattagccgggtgtggtggcgggcgcctgcaatcccagctactagggaggctgaggcaggagaatcgcttgaacctgggagatggaggttgcggtgagctgagaccccgccactgtactctagcctggatgacagagtgaaactgtgtcaaaaaacaaaaaaacaacaacaaaaaactgtacataaacacagtactttagttgggagcatcaaagaacaatatcacaaatatgtagttttaagatcttagtttgcttttttgtgtgtgattctagaattgggcaacactttattctgtaaaatagagtaaatgttccaacggactgagcagaggaggttgattttatagacagaaagggctgaagaaagcagaaacaaagaacaaaaagtggactggtcatttcgaagttactttccttgtaaagtgggaacagggaaacagaacaatagacaaataattgattggttaacatgaggttacttcagattactttttgttgtaaggactaaaggcaaagggaacttcattatcatgctgatggaaactggcctgcttgggatattgggctttgtctgtctcctgatttctcagaaggccagctaacaactcagttttagtctgatgatgtagatcttgttttgttttgttttgttttgttttgagacagagtctcgctctgt

SEQ ID NO: 2100 - DNA, 2350 bp, artificial
  synthetic oligo
catgtcatatgttccattcggttcatgaaagctagtgagagtcatttccaagggctgccaagagaatctaacttatagcaagagtaaagaaaggccacggataaaaccaagacttgcgcttcagaacgcaaaccagaaaatggaagcaacagatcctatctttggaccatgagagtgaagacaagaaaaagtaactgcagagaaatagatgcctgtgattgaagcaattcctcagtaatcgacactaatcagggcaatgttagaatggaataatgtagaattcaatagaaatgtatattacatccatcgggagccagatgacttcatcacagctaatgtattacaatgactagaaaaggaattaatgattcaccatttagttactttcctcccttcccccaacaccttttcttcagctttaacaaactggtctgaagccaactgcgacatcagtttagtaatgactttaagcaccatttacgctgctatcatggcaatttaaattgtcactttctattaaaaggtctacctcagaatggttttaagtgaaagcgttccacactgacagtgcaattaaacaagaaaaaaaatcctttcttggaatgtcagtgcaaacgcattttaaatagtggttcagcagcgccttgctaatttaaactacagtattgctttctactaaagaatagaaactgatttgggcttttttcccctctctgtactgtatgacagtttgaattggcactgtgtcccagtcaaagccctgatgtgccaatggggtccctgaacctaaagtgtatccttcccaagacagacattaaacagaaataatttaccagtgtgaaggggaagcttcacctttcacagcatttgcttttaaaattgcccttttctgatccaacttgcctttctcaaactgtggtctcacttgtttatcagggagagaatggagaggtatgggggacctactttactgagatgacaactttctgaatcaaaaatggacaatcgggaggccaaggtgggtagatcacatgaggtcaggagttcgagaccagcttaacatggtgaaaccccatctctactaaaaatacaaaattagccaggtgtggtggcgcatgcctgtaatcccagctactcgggaggctgaggcaggagaatcgcttgaacccgggaggcggaggttgcagtgagccgagattgcgccattgcactccagcctgggcagcaagagcgagacactgtctctaaataaataaataaaggacaatcaactagagaaaatttagtgtggaaaagaattctgagtacaggtgtgtgagtctttctctttcagatttctaagtttagatcctgaggcggtttatgcatttcgccaacctccttcaattcagctgagaaaagacccttcaggcactttcatctttgaatacattttaacacagaaacgataagggagcgcaaatgttgaacgtgccagtacaaaataacacgttttatccacctcatttgttttccggactcctgtagacccaatagtccataattcccaggtatttggcttagatagattccagctatcagagagaataacacaattacattcttaggtgtgggtgccttaaattagaagttgaagaatatttgaacagcaggaatggctggcattttcttttaatggtcttgaagcgtttccagcctgacagaaccttatgtcatgagcaatagctctgaagcacactaggctcaccagaagtaaacgaggcataacatttaagttgcttctgttacattctcaattgatatcgttattgctctgaaggacaccgagacagcatcttgagaaaagtgtcccaatgatggttatcgagatgcaattttttatgtctacacaattacatttctaacttcgccatattccacactcgactgccgtggaaaagatgatcgatgtaaacccagtcctcacaagaataatacataagccaccaggatcgaaactcatttttattttacaaattaggcaaactttctttcagttccattttcttccgttaatataacacattagtatttaagcccagggcagctagaaacagaagaaatgacctgctgatttgggggctgacaggggccaggaaagggtcacctcagaaagaagtattccttcctttttttcttttttgtattttctggtagagatggagtttcaccatgttgcccaggctggtctcgaactcctgggctcaggtgatcctcccacctcagtctctcaaagtgctgggattacagtcatgagccactgtacctggccagaagtattccttcttgaaaagtggaggtgaagggaagg

SEQ ID NO: 2101 - DNA, 2100 bp, artificial
  synthetic oligo
gtatgaacagaactgcttggcatgaaacaaggaaagaaatttgtgttttgaaccagagagagagaagagagaaaagtaaaatgagaaaatggagtaagaaaatgggctgaggaatatggggtatactctgtaacccccaaatcttcagtgaagttctaaagtcacaaaatgctcatggggacagtgggggtgggggtagtcagggatcttgtgcaacaaccgggaaagggtctgacctttggcaagggaaggaatcaagaacacatgcagagacaacaaattagggccatgaattagggccaggatttgcagaaattgtaggaagggctgtggattctcattgtctgtgacacctggggtttcagccaagtttaccttaacctctgaaggccagagcagcttcatctgggatatatttgcaaggatttgagagaagtttcttatacggacacagtcattggatttatagtccaccctaaatccagtttttcatttaagctacatggctgtgaagccacgctgtggtttttcattgagttctgtacactgtattttttgagtcatacctggaatcatgatcaagtttccatggggcacaggaatctctaatgcatgcttcccaattctgactgcattaggagtggaagaggttagacaatattcattatctggccaaccacctcaatccatccacccatgaactcagcaagcatacggaacactttctatgtttaaggcacttgtcgacaaagatggacaagacctagatcctcatctcaaggagcttagtctaatgacacatgtagtgctgttgaattgtgctcacccaaaaagatatgtccaggtcctaactctggtacctatgaatgtggccttatttgaaaatatggcctttgcagacataattaaggatctcaggataagaacattctggatttagggtgggttataaatctgatgacagtgtccttttaagagacagaaaaggaagacacagagaaaaagatggccaagggaagatggaggcagagcgactcatgccgctacaagccaaggaaaatcgagggtttttcctttaagctatgtggctgtgaagccatgcagtggtttttcattgcgttctgtgcactaaattttttgagcaatacttggaataatgatcaggtttcctcggagcacaggaatctctaatttttcccactgaggccttcagagggaaccagctctgctgacaccttgactttggatttctgggctccagactgtgagagaataaatttccagtgtgtttttttgtgtgtgttttggggggggtggtggtggtggggagacagagtcttgctctgtcgcccaggctggagtgcagtggcgtgatcttggctcactgcaacttctgcctcccaggctcaagcgattctcatgcctcagcctccgagtagctgggattacaggtgcccgccaccatgactggctaatttttgtatttttagtagagacggggtttcaccatgttggccaggctggtctcgaactcctgacctcaggtgatctgtctgccttggcctcccaaagtgctgggattacaggcatgaaccaccacacccggcagaatttgttgttttaagccactcagtttgtggttatttgttacggcagcacttaggaaaccaatacagcaacttgtactgcagtagctaggtaccaggcagaaaggggtaaatgccacaacaaaagtataagatgctttgacagtttggatggagaagagctgacttaaagttggtgagagtgcaggagaggcggcggttcagagaggttttatggtggtggcaacatttgggctgaatctgagggaaaacatatgattttgacattcagagatggtggtgtaataaattggtcacatggttctagttaactccacttatctcatcacatagaacatcggtgtggctatcaaggaagcagatagcaccctctggtgcaaatgtgaaaacactcctcaacaatatcacccatcctcactaaatttgtttttgagacagggtttcactctgtcgcccaggctgtagcacaatggcacgatcatggctcactgta

SEQ ID NO: 2102 - DNA, 4550 bp, artificial
  synthetic oligo
acctggttaggatttggacactttaaaatactatattaaaaacaattatatcaacagcaatgacaacaaaaggagtaacttaagcaaaacaatgcccctttaggaaatcacttcctgtttctaaataaaaatcggtggattgtgcttctgtgtaaagtgtgtattttaaaatgtaaaataccaaaacatgagaaaaaaaacaaaactcaagtaaaaactgggaattcatgtgggtcagtgctcccatgcttttaaaagagaacaaactaccacaagcctcagggagctggaggggttggcttgcctcccttcctctgacctaccaactggctccctgcttgcacacctggatgtggctgcactatctgaacagcgcctgttgccaaaaacactggctgctgcaggactctcaaaggctgtgtctggagctggatctgctgtggctgtggttgtggctgcagcagcagcagcggctgtggctgctgccccaagacaaaggggagctggacaccctgctgaggaacctgggcagagccaagcagactcaacacagcagcctggggctggggctgcagaccactacctgctccagtgaggttcacattaagaagttgctgagcagggaaggcctgcccttgcgtgctcaaacctagtgtggaaccctgtggccctggctgaggagggtgagcagctgtgggctgctggagctgctgcagggaaaccagctgatgggactgctgctgcgggccggtcagaaccgcccagccctgcggaacctggagtgtcagaggcctgagaccttccggagtatttaggaaaaactgaaggggtgctggagaagatgcctgcactgcaccgggccttgcatctggtagtggacctcctgaggactgaaggccactgccactgattcctgcaggagcgggggcacccgagccaggggcctgcacaggcttgaaactgcaccccaaaacctgggctccccggactgggccctccacgttggtggcctttaggccagtggagcctgtccggacctgaatggctggggctatttttacgaatctggtggggcgcccggcagctggacggcgcctgctagctttaataagaggcacagagggcttctgagaatggcttggtgccgccccaccggccgccgccgccacagcagcagcagctaaagcaggagcagcagcaggagcaggagcaggagcaggagcagcagcagctacagcaggagcagcagcaggaaatggacgcttaagagggctgcctgcctgttgtgggggaaaactgttacctgaggaaatctttcctgagcttgagggaagttgggtgcggggaggtggatgtttctctcccttcccggatactgaagactggacccacacaggatcaggctgttctggtgttttccatgaagagagctgactgacactggctgggccactggagctgtgtgacatcttgcctggacctttgactttgctctgcaccgattcctgggcctgactcactgccctcccagcatcagtctctgacccaggcctgagacaagctgaatggtcatctgggaagggctgccagggagacttctggctcttctgcctggcttttttacgtggccgtattttaccacagagaagcggatcattaaacgactgcatgatgtttggcttggtgtcccaggcctgacagccagcttcccatgcatgtctgaaagggtcttctacctcctgggctggccagactgggagctgtgggtcagcagctgtgacggactgataccctttagcaagtttctccacatccacttctgaaggcacggccaaatcacagggtctgcctttccacgtgtctacacaacttcccgctttagtaatgttcagctcacaaggctgacctacttttctttcttctttttggccagaagtcgacactctcagctcaggaggaggtggacagtcagactgctcctgctgtggctttacagagggccacgaatacctctggaggcactgttccatcgggtcggtattcatcttttgcttgttgtacagcagcctgtttgcagtgcaggcaactgctacagaaggatcaagacacagtggttcagctgtcgctaagatcagttgactctcaagaggaaatttgtcttcctggctccatttctcgccatctcttgtcatcgtcttcacctcaggggctaaagtctgcatggttggacgtagaagaatatgcctgctttggtaaccaggaggttgcatattactggactgcctgtagtcacgaacttctactatgacacacccactatgaaaaatgttaaccgaagctttatccaggacatcacccaaagcagggggtaattcttctgcatccaagtagtccagcaatgccctttcttcataaggcagccgaatggtctctgcaaaggacccatcttctctctggagcatcacagaatacccctgattgcctgggtatagattgaccagtaaacatggcaaggactctctcctaacaagcttttctaacaagtttacattgcttctcaattcctgaggatcctcaggctcttttccacattcttcaacataaatgtcataaagtttttcctgcagagtttttcccgccctaggtgagtatctccttctaggacgtctctgttgggcaatttcagtgatattctctgtgcgatccagagcctgttctaaatctcgatccattgtaacagaaaacagggcccctaagaggagagaaaacgcatgtgcgttggtgaagcagggtggaatcacggctgtcatattaatctacaggcccgcaagacgccgcaagtccacactgagttcaacacgggcacctgcccagaaacccgcccccagggaagcgctacccaatctgtttgagggtttctgaaaacatgggtacctgaggggtcgtcgtcgtggccgggcttcacgtctctgcggcctggaacagaagtgagcgggagggccggggtcagcttctaggcgcgtctgggcacctgcccagaaacctgcccccagggaagcgctacccaatctgtttgagggtttctgaaaacatcggtacctgaggggtcgtcgtcgtggcccgggcttcacgtctctgcggcctggaacagaagtgagcgggagggccgtggtcagcttctaggcgcgtctgggcacctgcccagaaacctgcccccagggaagcgctacccaatctgtttgagggtttctgaaaacatcggtacctgaggggtcgtcgtcgtggtcggacttcgcgtctctgcggcctggaacggaagtgagcgggagggccggggtcagcttctaggcgcgtctgggcacctgcccagaaacctgcccccagggaagcgctacccaatctgtttgagggtttctgaaaacatcggtacctgaggggtgattgtcgtggcctgggcttcgcgtctctgagtgctgcaccggaaatgaacgggagggccggggtcagctactgcgcgccgtctgcgcgtctgcgcgcgtgcgcacttgccgcacaccgcagattccaggcgccccctgcttctctggcttcctgggcgcgaggctcactcgctgcacttccgggtctgctgcccgcgccggcactcgactacttgccatttcaccttgaaagcgtacatgcaaaagcacgagccactaaggacagtataaacacatctttcgtaccgcgcatagacatcagtttccacaggaataccactgtcgggaaatcatgggaagttgtcactggtcttggcggaaacttcaacaattgttggcacttttggaatctcttgccatcagtggcagcactgctgctggtatcagccactgggctgtggaatgagcccgcattagcagtgcttccatgcctggagacgccacaggcttgtggcaagcgtcagggttcttcatgttgtcgtccagtaagctcccgcctgggggtgttcatgtggatgccccagtacatgacgttcatttacataattactcaccttttatttctccatgtgttgagttagggcacctacagattaaaaaattacctggtgggtcattacattgtctatggattgcaggtcaggatggtagagagacatgaaaccattcatttctacaaggtgatttgcacctgataaggacgagaacaattgtccaggtgatggcaataaattttcaatgattagagtaaactgtagaccttagctaagatcctaaagatggatttgcagcaatatcattcagtcttaggtaatttatgggacattgttttccattaactttgttgccttgaaatctcccagtttgtttgtttttgtttgttttattggacaagatcaataatgcttttctggggagatctactccatagcctgtttttctgactcatgagtgtgatctaaattctgcccctccctccgctgatatcccagggtgcatcacacttattagcgaggtatagctgcccgccctgccatgggatggactcgatcttcagctggtgaattgcct

SEQ ID NO: 2103 - DNA, 2650 bp, artificial
  synthetic oligo
atacctctctaataagtgagatgcaccctgggatatcagcggagggaggggcagaatttagatcacactcatgagtcagaaaaacaggctatggagtagttctccccagaaaaacattattgatcttgtccaataaaacaaacaaaaccaaacaaactgggagatttcaaggcaacaaagttaatggaaaacaatgtcccataaattacctaagactgaatgatattgctgcaaatccatctttaggatcttagctaaggtctacagtttactctaatcattgaaaatttattgccatcacctggaacaattgttctcgtccttatcaggtgcaaatcaccttgtagaaatgaatggtttcatgtctctctaccatcctgacctgcaatccatagacaatgtaatgacccaccacgtaattttttaatctgtaagtgccctaactcaacacatggagaaataaaggtgagtaattatgtaaatgaacgtcaggtactgatgcatctacatgaacacccccaggcgggagctcactcgacgacgacaggaagaatcctgatgcttgccacaaatctgtggcgtctctgggcatggaagcactgctaccgcgggctcattccgcagcccagtggctgacagataccaacagcagccttgcaactgatggcaagagattccaaaagtgccaacaattgttgaagtttccaccaagatcagtgacaacttcccatgatttcccgacagcggcattcctgtggaaactgatgtctatgcacggtgcgaaagatacatctataccgtcattggtggcttatgcttttgcatgtatgctttcaaggtgaaatggcaagtagtcgagtgcaagtgcgggcagcagacccggaagtgcggtgggtgagccttgcgcccaggaggctagagatgcaggagccccagaacctgcggtgcagcgagtgcacatgcgcatagacggggcccaggagctgaccctggccctcccgttcgcttccggtgtagcatgcagagacgtgaagcccgggccacgacgacgacccctcaggtaccgatgttttcagaaaccctcaaacagattgggtagcgcttccctgggggcaggtttctgggcaggtgcccagacgcgcctagaagctgaccccggccctcccgctcacttccgttccaggccgcagagacgcgaagtccggccacgacgacgacccctcaggtacccatgttttcagaaaccctcaaacagattgggtagcgcttccctgggggcgggtttctgggcagatgcccacgttgaactcagtgtggacttgtggcatcttgcgggcctgtagattaatatgacagccgtgattccaccctgcttcaccaacgcacatgcgttttctctcctcttaggggccctgttttctgttacaatggatcgagatttagaacaggctctggatcgcgcagagaatatcattgaaattgcccaacagagacctcctagaaggagatactcacctagggcgggaaaaactctgcaggaaaaactttatgacatttatgttgaagaatgtggaaaagagcctgaggatcctcaggaattgagaagcaatgtaaacttgttagaaaagcttgttaggagagagtccttgccatgtttactggtcaatctatacccaggcaatcaggggtattctgtgatgctccagagagaagatgggtcctttgcagagaccattcggctgccttatgaagaaagggcattgctggactacttggatgcagaagaattaccccctgctttgggtgatgtcctggataaagcttcggttaacatttttcatagtgggtgtgtcatagtagaagttcgtgactacaggcagtccagtaatatgcaacctcctggttaccaaagcaggcatattcttctacgtccaacgatgcagactttagcccatgatgtgaagatgatgacaagagatggccagaaatggagccaggaagacaagcttcagcttgagagccagctgatcttagcgacagctgaaccactgtgtcttgatccttctgtagcagttgcctgcactgcaaacaggctgctgtacaacaagcaaaagatgaataccgacccgatgaaacggtgcctccagaggtattcgtggccctctgtaaagccacagcaggagcagtctgactgtccacctcctcctgagctgagagtgtcgacttctggccaaaaagaagaaagaaaagtaggtcagccttgtgagctgaacattgctaaagcaggaagttgtgtagacacgtggaaaggcagaccctgtgatttggccgtgccttcagaagtggatgtggagaaacttgctaaagggtatcagtccgtcacagctgctgacccacagctcccagtctggccagcccaggaggtagaagacccttttggatttgcgttggaagctggctgtcaggcctgggacaccaagccaagcatcatgcagtcgtttaatgatccgcttctctgtggtaaaatacggccacgtaaaaaagccaggcagaagagccagaagtctccctggcagcccttcccagatgaccattcagcttgtctcaggcctgggtcagagactgatgctgggagggcagtgagtcaggc

SEQ ID NO: 2104 - DNA, 1550 bp, artificial
  synthetic oligo
gaaaagttggatccactcccaaagggcttactatgtctggggtgagacaagatacggtcacatgaagtgcgtggtaaacaagatacgccataatgtcacagttatgccaaatgccataatttcaaagttatgccaaacatcataatgtcaaagttatgtcaaatgccataatatcaaagttatgccaaacagataaatacaatgcatctccaagaagggagaaatccaccttggccccagacatcagaaccagactgcctggattgattgctggctctgccacttactggttgtgtgaccttgggcaagtcacttgctatctatatgctcagtttcctcatgataaaatgaaatgataaatgtgccaatattatagggttgccatgagcattaaatgacatatgtgagagtgcttagaacagtgcctggaatacataagtgctaattaaatattagctgtcattgaagggggagaggaaacggtagagtaggaaaaagggcattagctttcataacctacatccatccaggcaccttctttaaatataacttaaactccttgtgatcaatttgatactgagtagaactgttatttatggtgtaattagctactctcaagttcacttatgtagcaaaagtcaggaaaaagtaaggaaaataggttcttaggtaaatgtccccagaagtagaccttcagatgaggattcacaagcaagtgatttattaaggacatgctcccaggggaggcagggagggaatggaggacaggacagagaaggggagggagctaagcaaatagattatcttttttttaaaatttttattattattattatactttaagttttagggtacatgtgcacaatgtgcaggttagttacatatgtatacatgtgccatgctggtgtgctgcacccattaactcgtcatttagcattaggtttttttttttttttaattacaaatagatgatcttaagtgaagtcactgccccagcccgatcccacaggggagctcttgggggtaagttacacccctttagtgtaccacaaatccaaacaaggcagctggactttgagatgctcacacctgctggtcattggctaaattccaccccagggaacctaaacctccaggcaccatgagcaaagcagtgtcaaaagtccacgcgggcaggaaaaacatacagaatttcagggaaggccactcagaaacaggaaaagggtggcgccatttgaatgaagcagctgctatcgtccactgaatattatgggttttgctgaacaaggctgggcaaagaacttactggggcaaattggtgctgctaattggtgaccacccaaacttccaaacagtggatctcaaacttcaggctgtgtaagatcccctggaagtcgtttaaaatgtagattcctgggcttcatctccagaaattgtaattcagtgggtgggactcaggaaacttcattttcaacatgctccctgggtaatttggatgtggggatccttggaccatgccctgagaatcactgccttaggggactggcagg

SEQ ID NO: 2105 - DNA, 1100 bp, artificial
  synthetic oligo
agttgtctgtcccaagcatcagacttaggagtgaaggggccctcggatgtttccagacccaagatctagtcaccctgcagccttcgggttttcccagctgaagcccagataagccatcccttctgcgtgctgtctaaattcctgactcacagcatctgtgagtatcataatatggactttggactgaaagaagtcgtgtaatatctagatgttttggggcactgaatttgatagggaataaagtgtgcgtgaaatccccagtatttggctctttgtctctgaagttctgactcactctttttgtttttgtttttttgaaatggggtgtcactctgtcacctgggctggagtgcagtggcacaatcacagctcactgcagcctcgacctcctggctcaagcgatcctcctgcctcagtctcctaagtagctggaactatagtcacgcaccaccatgcccagatgattttttatttttttgtggagactgggtctccctatgttgcctgggctggtcttgaactcttggactcaagcagtcctcttgcctcagcctcccaaagtgctgggattacaggcataattggctcactgttattaataaccaaaacatggtctggcctagagtggaggcagccccaagtttggcagattccaaatctgcagcctattttgatccttcttaaattcagaaataaatgttcttgaacaaaggaaaactcttaagctcttaaggcagtgagaaactgctcatgaaacaaaacaaacattttaaaagtagaaactaagtttttaaaaaagtgattctttgaaggacattcacaaccatttggtaggtctccattcacatgtcagattgtttcttctgaaggactattcaattaatcattgtttaaccctagtaaatcaaaaaattaatgacttattctaaaattcagtgttttcaacagattgaaatcttataactacaactagagaaaagaagttgaagagctcacctgcacacatggacataaacatggggacaacagacactgtaaactactagacggagggggaagtgggcgcgggttgaaaaactacctattgggtactgtgcaca

SEQ ID NO: 2106 - DNA, 1200 bp, artificial
  synthetic oligo
gtagcttaattatttcacctccactcaagaaagattataaagttaaggagaatagaaattgtttataggtgaagccgggtgcggtggctcacacctgtaaatcctagcactttgggaggccgagacaggcagatcacttgaggtcaaaagttcgagactggcctggccaacatgataaaaccccatctctactaaagatacaaaaaaaaaaaaaaaaaaattagcccaggcatggtggcgtgtgcctgtaatcccagctactcaggaggctgaggcaggagaatcgcttgaacctgggaggcggaggttgcagtgagccgagatcccaccactgcactccagcctgggtgacagagcgagactctgtgtcaaaaaataaaaaaaaattgtttctaggaacagtacatgtcaaccctgctctgaccatttctccaagtttctcacattttggtcaactgcagctgatatttagtcaatatggtgccttttctagaatacacattatagtcgtgtcaaagactaacataaggcttctatcagctacagatatttgggctcttaatgagatcttcagattttactcttgattggtttctacttgatggtttcttaaagaagttgatcaccaagtatactttgatgcttatgaactgtcacactctgtctcaaaagcatctctatgggagtccttttaatctaatagttcctgctgaatacctggagaagttgcctaaacattcaactccagttaccaatgaagactccaagacaagaggactgtgtgtgtgtgatatgtgtgggaacacttttgatagtgtaccttttcccccaggaattatgttcattaacaaaggctaattctcttgggggcaaatatcaaggttcttaaatatgggttttagtacaccttgtaactgattgttttccccttgagaacatgtctgaggcatcatggaagtcaagaagaaacttgtaactgttgcttgaaatacaacctgtcaagaatgcatttgatctatgtggtgaaaccaaatagtatggtgtacgaataataggtattccattttaaaattcattcccttgctgactaccagcctggctttatttattctggacccgaggctaatgtcagaactgtggtcatttcaaaaagcgcaacctctccagatggagttaatggaatttccttaatttggcgag

SEQ ID NO: 2107 - DNA, 1200 bp, artificial
  synthetic oligo
ttgagctttaaaaaatttttaaattactttcatggtatctacccgtaattcatttttctaacatcagacaaacactttttgagtccttgctgtgtgccaggcactgttctagcttctgaggatacaacagggaacaaaacaaaacaaaaaattttgccctcataacacttaaaaataataaacaagcaacaaaaaagaacataaaacatgtagtattttagttaaagggtgattaagtgttatagaaaaaaataaggcaaggaaagggaatagggagtgttgggggtatcactgtaaataggatagtcagagaagttgatgtatgtgtaaatatataaaggatcaagtgagccatgtggagaaagagcattcctggcagagaaaacagtaagggccaaggccatgaggcatgaacatgcctggcttcttccaggaataactagaaggccagtatgcttggaggaagcgagcaaaaaagaaaagatgtagccagaggtgagaccagaagaaaggagatgagaggcacccagtcgtgtgagctttttaggacactgtaaagactggctttcactctagggagatgggagccatcagagcgtttcgttttgtttcgtttttgagagggagtctcactctgttgcccagggtggagtgcagtggcgcgatctcggctcactacaacctccgcctcctgggttcaagagattctcctgcctcagcctcccaactagctgggactacaggcgtgtgccaccacacctgcctaatttttgtattttaagtagagacagggtttcgccatgctggtctcgaacgcctgacctcaggtgatctacctgcttcagccttccaaagtgctgggcatcagagcgttttgaacaaggcatgataatgatctgacttagctttaacaagaccatctggctaatgtgttgagaataaactgtaagaggtcaaaggtagaaacaagaaaaccactgaggtgtctggtgtaataatcaggcaaaagaagacagaggcaggggtcagggtgatcgcagcggaggtggtaagaagtggtcagattctggatagattttggatccataaaacttgaaacagattggatgtagggtgtgaaagaatgagaggaatcaggataattccaaagctactggcctgaagaactggaaggatggcattgccattccctaggagggg

SEQ ID NO: 2108 - DNA, 19350 bp, artificial
  synthetic oligo
ccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctggaaataactgaattttcttgaagcccttacaacctctggtttaaaaaaaaaaagttaaagacgaagcttttacaaatgtaaaaaattcccagttcaaatcgatccataacttacttcttttgcaccgagtgtgtcaatctgaactcatcaatcagaaaaacagaaatcgtgcttctaaagacctgcaggattttaaagttataccaaggccaccaaaacacttactaggtagggcctagaaaggaagaatccaaaaatagtagcgacaacagctcccagagtcccttattttgcgatgtgtcttgctaattgggaagttcaacacgaggctttccctgcccatacaaggctggtatttcagagcgggaggagcagatggaaggggtcctgtgggaagggaggtgtgggtgtccctgtgtttaattaagagttgtattgtgtggaagggaggaggaaagatgccgggctgcacagccctctgttcccttcatcgcaaaataacctgcaagtgaaaaaaaaaaagaaagaaagaaagaaaaagaaaaaaaaaaaaaagcccgctactaagacggagccggctctggaatagataccattagaaccacagtgtttctggaataaagatatctaatttcctgccgcaaatcacttccccgatcagaaaacacaaatagctgaacagaagggggaaaaaatagaggactcctccaaacccggggcagtgctatcctcctcccaaccacccccactctgctcccgactttccagcccacccgggatcccttttgaggacacccagcatctttgagggaagggagacggctcccaggctgaggttgggacagcgacggtggcggagaactggggcactcacggcctaggggcctcgtggggccgctgaggccgggcctgttcggcaccgacggcgtcacctcctcttctaaccggtcaccccgggcagggccctcctcagggcaccgcttgcccgaggcggcctcggtttccctgtctggaaggaggtgcaggagcccgggggcaggggagctccgggcgccctgctggggccgcgctacttgggggcgttgcggcggcggccccgacgccccttgtcaaatcgcctccagggtctcggggacccggtgaacaaagccaagacccgacccccggtggccccaatggcgcgggtgaatgaggacgctggacttaggggcgcccgcgagagggcgcaggctgggagggcctgggaggagaggcgccgggctccgcgtggggctcgtgaccgaggggcccccaggacgcacagactcgatcgcgcctcgaaaatgaccgtggtggtagcaggtgcaggcggagagtggaggcagaaggagtgggaggaggagagcaaatacatctactcagatgctaatgcacagaaagtgagccttagctgttttttctttggagattaaatgaaatctcaaacggatttgtttttgagtaggaaattgtagatttctcacaatcgcatgaaattttgtgttgcacgcctctaatcaacatcacattctttgcccccactttaggctttgcaggtcttagtacagttctggtacccaggaacatctttcccgaaccagaaaattgcactgtggctgtgggagtgtagtaggtacttttatttgggcaaatggcacttgatgtttcatcctcatgaggtgggcgctgattgatcttttcccttatttaaccaggcctcattcttttccctcaattctcccattactgctgttggggccatttcattgttcattactcctacggtttaaggcttgcaagggactaaaaagaaattaaaagcaacgtattttgcttagagaatcccagaaaggctggaaagaaaggcgattgaaacccacggttcaagtgaagtttagacataggagtgatttttacatatttctttttcatggataatagggagttggcgttatctgtcactgtacgttctacctaataaatagctgcaagactataatctaacaggtgtaaaatttcccttttctgacaaatgaagagaccaccaacactatcttaaacagtacaaatagaaaatgctgttgttgacaatctttcacactatggagtcaattctaagctagcttgctttctctttcttttctctttctttctttctttctctctttctttcttcttccttccttcctttcttccttccttccttccttgcttgcttccttccttccttccttcctcatgcaggcctggcttttggggtgtgtaccccacacagagagttataaacaaagataggctgatttaatttctgccctcccccccaacacaacctgcaaaaatatcgaggaggggctttttactctctgccaactgcaaaagggactgatcatcagagaaaatgcctgtcctttctttcactcatttctcttgatctcctccaaaaatatggcctatttagttattaggcatcacagattgggaaaagaaaaagaagcagagagggctgtcccaaggctccattccctaggaggtcccacttccatctggcatatgttgagtcctcctgttttcctctcaaagggagccttgtttatggaggttttctctgcattcatttgttcccagccatctcttcaacagctgtccccccaccttcccaggatcccattggtcaggcttcgctcccactgcatggaatgcaaaaatatctcacccagaaatgtcttgtcaaagacagagagggaaaccggcccaggcaatgctgcccttgcatgtcatcatggaccaattcttacctgtttctcctcaccctctttctctcttcttcagcttctgggttgaagcattttgatgttatttatacgaaggaaatgacattagagtaacctttttattgcattacactaaaaggagattgaactataactttgaaaattgtgacattccaatgagagctatattaaattgcttaaaaacatttcgaaggcatcattggtattgtctgtagtggtaagtgaaacaaaggatttcacagcatgtcgggtttaatacaaactatgctcacatttaagtctttaagctattaaatagaagagaggagaaaggggatggtgaaatagtatcagagggggatggaagagagagacagaagatgcctaagagaagacaatcctgagaataaaaggtggcacagactgagtgcttactctttgccagtacttaaaatgtgtttcctggccaggtgtggtggctcaggcctgtaatcccagcactttgggaggccaaggtgggcggatcacttgaggtcaggagtttgagaccagcctggtcaacatggtgaaaccttgtctctactaaaaatacaaaaaaatgagccaggcattgtggcacgcacctgtaatcccagctactcaggaggctgaggtgggagaattgcttgaacccaggaggcagacgttgcagtgagctgagatcgtgccactgcactccagcttgggtgatacagcaagactctatctcaaaaaaaaaaatgtttccttcatataaagaacaccaaaatgctagacggctgctctaagtgcttttcacacggatcaacgaatcctccagacaatcatatagcgatggttctattagaatccctcttttacagatgagaaaaccgaggcacagagagggtgtccaattcagcctggttttcccaggatttgcctgggtttccaggtgaaagtcctgtatcctgggaaatccctcaatcccaggcaaactgcgatggttgctcacctgaggcacagggagaagtagtttgcccaaggtcggagaggtggagccaggatgggaatgagctaggcagtctgactctggaatctgctgctcttatcctctgtaaatctcacccatttttacagaatgagtaacttggggcattagagagagatgaactgacttgtccacagtcacagagcttgctagtagtgggtggatgactaaaatttgggactaacaaatcacacctcctttctactttcagctaccttctgaaagaggttttgtagaaaagaaagcagctttaaaaaaatcttagaagtaaggagctaaataaataaacacatccaagaaaaagacatctaccatattgagaaacatcacgacctggcagtattagaatatgtagcaaaaggaggtcacctatattgtaaacacaatttataatgaaagacaatttcaaaattgcaataagtacacaaagaaaataattatatggcacatgtggccattaggcagggaacattttaactccctaaagcatttggtgtattgttctgattccattattgttcactaatgatggtcattgttccacctcacgtcatcctcaaaactggcagccccctgcagtggacattgtttccaaacagcttctctaggacctttcggacaaacctgcaagaactgatgatgttctgcgcatggagttggtaagcaggttgtagctgggcattggccgggaaagaaggcattctcacttggaacacagctcattgtaaaaatgcagtttgacatcaataaaaataatcactatttgttgtatttcttataattataggtcatctcttggtgaggctctgcagttcgtaaagtggcgatttggcctctgtcatgctgatgctggaggcagccaggccccagagcctctcctggcgggcatcctgaatgccagaagcttaggcacaacttcagggaagaaaacattttggaaatgacgagaaaactgtgagggagttgcaactgtaaacagcaaatgtgctaaagaccagagacttatgcagagctaaaagagggcaggtggagctgttctcagttttttacatgtgaagaaaacattgggctgactccattctggttccgcagagctaaaatgtgccttgatgactgttgttgttttattt

SEQ ID NO: 2109 - DNA, 1450 bp, artificial
  synthetic oligo
ttgtatttttgtagagacggggtttcgccatgttgcccaggctgttcttaaactcctgagctcaagcgatctcccctcctccgcctcccaaagtgttgggattacaggcatgagccactgcacctggcagagcttattatttttatgtgcgtttctttcattattagtgaggtcaagtattttttcatgtgacaattggccaattgtattgcctcttccatgactcatcggttctcaattgcttactaatgtgcaaattattttacccacgggtgctatgtcttaaaagtttgctagagctttataaaaagctggcatgagaatcactgtgagattatcgttagttttactctgatttcctttagcttctaagcataatggccagtgtttattttcatgcgttttcatgagtttatttcacaagctgaaagaccacatttcttggcctccctttcaggaaggagtggccaatttaactaaattctggagaaggacgcgttttgtgtggtgtttccaggaagtcatcttaaaagagaggagttttatagaccaatgtccctctcttagtcttctagatggtttgtcttgaagggatgtgagacaaagactgctaattgcatccaaatatccattcttttggtggtgggttaaagagactgcaaattttgtgtcactcccggctgctgctggtactggggcccgaggagggatatgcccgagtggggccgcctgaccaagggagcgacaaacatgacacccgccgacgcctcagccgcttggggcctgcacggaccctctgcttcagtgcagaatgaaccaaggagactcaaacccagcagctactccgcatgcggcagaagacattcaaggagatgacagatggatgtgtcagcacaacagatttgttttggactgtaaagacaaacagcctgatgtaccatttgcgggaggctccgtggtgcagttactgcagccatatgagatatggcgagagcttttttccccacttcatgcactgaattttggaactgggggagatacaacaagacatgttttgtggagactaaagagcggagaactggggaatactaagcctaaggtcattgttttctggctaggaagaaacaaccatgaaaatatggcagaagaggtagcaggtggtatggcggccatcgtacaacttatcaacacaaggcagccacaggccaaaatcattgtatttgatctgttacctcaaggtgagaaacccaaccctttgaggcaaaagaacgccaaggtgaacccactcgtcaagatttcgctgctgaaacttaaccaacgtgcagctcctggatactgacaggggtttcgtgcactccgaccgtgccatctcctgccacgacatgtttgattttctgcatttgacaggaggtggctactcaaaggtctgcaaacccttgaatgaactgat

SEQ ID NO: 2110 - DNA, 1050 bp, artificial
  synthetic oligo
ttcaattcagtaaggattaataagttaatattaaaattagtaacccttccattcttctttgctttctagactccctttccatttcttcaggttgggatgtttacaatgaaaggagaaagggcaaaatgagcaatgtgaataacagaatagtccagttatttgaaaggagaacatacttccatagttcccaaacatttagttttaaaatgacctccaagtctactgtaccaactaaatgttattgacagccatctggtagtgctgtttgtttgtttgtttcattggagggttcagttatattgcccaatacaaaacacactatcatcattaaaacacataagcctgtcccctccctctctccttccctccttccctcccttctttctatgttgattatttcattacttccctccctttcatcaccacacctcactctttcccttcccccgactggcaataattccaacgtgtctaatatgtatattcaaatttgtatgtatccttgcagaatatgtaagattattttgtgggcatgtttaaaaatttacattaatggaaatgtaaattctgattcatacccaaaacatgggtagatagaatattttcattcagaaccatgcccttaatatctacccatattttgggtatctatctactttgttgctttgaactgctgtatgatatgctacagagtgcatctctcacattttacttttccattatccccctgagatagacacttgggttgctccaagtttctctatttcaagttcctttaccacagataacactccttatgaatgtccccttttgggctgtgtgtgacttttctctgggatatagtcccagaagtgggactgttggatagggtagtgaatactctgatcacattctgccaggtagctctccataatagctgcaacaatgtttgtgtgtttgtgtgtgtgtgcatgttctcagagcctaaggtaaaatattatgtgtcagtcattatccttgaaaatccatgaagccagattggggaccattgtttggggtgagggaaatgat

SEQ ID NO: 2111 - DNA, 1250 bp, artificial
  synthetic oligo
ttaggaccaataatgcaatgtgctacttactgaactagtggagttcatagagactatctacaggctcttagcgttgaaatctcctttcctaagtgaaagaactgagaccagctccaatgtagaggatgtagtcttaatattgtcttgtggttgatgttgttgaagagtctgtgggcccatgtcacaaacattcaggtatctggacccactcagtcctaacacaggctcacccaaggagatctctctttatagatactccctttcatacctgtagttggctgtctcctcttcataacctctaaccctttgttttttttttttccctctataagaccctatcacacatattaacagctggtaaatggctggaatgaagggtacatttgcgggattgaagctgggtaagtggtttgggaccaacttgtggggaaggcaagaaagttgggacttgccttccaccacaccatgggagcccttgaaatatggtttcttttgggaacttcagacattttggagaattaagtttttaaaaagtatttaatggtcttctgtaagctaatattttttatttaaatttacatttaattttctgtatattcccatggtttgaaattcagaacaatacagaaaagtatacattcagaagttgtcttagtctgttttgtgctgctgtaacagaataccaccgactgggtaatttataaagagcaaagatttggctgggtgcggtggctcacgcctgtaatcccagcactttgggaggctgaggtgggtggatcacgaggtcaggagatcgagaccatcctggctaacacagtgaaaccccgtctttactaaaaatacaaaaaattagccgggcatggtggtgggcgcctgtagtcccagctacacgggaggctgaggcaggagaatggcatgaacccgggaggcggagcttgcagtgagccgagatcgcgccactgcactccagcctgggtgacagagcaagactccgtctcaaaaaaaaaaaaaaaaaaaaaaaaagaaaattatttcttacagttctggaggcttggaagtccaagactgagggaccacatctggtgggggccttcttgctgcatcataacatggaagaaggcatcacatggccagagagacaaagagacagagagagacagacagagagagagagagagagagagagagagagagagagacagacagacagacagagagagagagagaaagcgcgtgagagagtgagcaca

SEQ ID NO: 2112 - DNA, 1000 bp, artificial
  synthetic oligo
agtggtcaacaagttaataaaaattattcataattcaactttatctgttatatcagcaaacctttatatacatttctaaatgtgacacccaatgttttacactctccttttttcgttagaaactaaagaggattttaaaaacatttcactttgggctatttatcatatttcaatatacatatccagataaattgccatttttcacatttatgcattttaacattttatgcctcttgggaaagttcaacaaaatattttctgacttaaaaatattgctttaattttcctgtgtagcttatggtaatgttttattgtttcattgtcacataaaatctacctttatattcatatcatgttgtgtatatgcattttcagatgtctagtgacaaaaacaaaatgttagccaacactactaagcagaataagctggaaatttagagttgtcacttagttatactttgtgacttcaaacaagttttaaaaggtttgtgctttatttttctcacctatacaatgagcatgctaaaactagcccttcttattttataacatcataaaaattaaaaatgacaatacatttaaaagatgtctgtcttagtctgttttgtgttgttataacagaaaagaggtttatttatctcacagttctggtggctggatagtctaacagcctggtgctggaatctgcttggcttcttgtgagggacatgtaatgcatcaagcatggtggagtaatggaaaggcaagtggatgtgggcaaagaagaaggggaaccaaggaagctgatccactttataacaacctaatcccatgggaactaatctattcctgtgagaattaatctagtctgtttcaccagagcgaaaactcactcactaccacaagaatagcacaaatctactcacaaaggatccaccccacgacccaagcacctccctctaggccccagctgccaaccctgctgcactgccaaccaaattttaacgtgagttttcatggg

SEQ ID NO: 2113 - DNA, 1050 bp, artificial
  synthetic oligo
atggggtcctacattttacagcacaggaacaggctagtgcccataagggtccctaagacccctgtgaatgggcagtcttgtcaccaaaaaggcatccggggcaccaatgcggggacaaacttagactggaagtgctctgccaacaccctgcaagccacgtgtcagttaagagtctcaaatctgaagaaggtagaatagactgaggaagaaaggactctcagttcaacagcaggcagggtgctagtcagaagagtacttggtttgttacaatccaaactcccagcagaaactaagtacaaacagacttgtacctaaaaggacccatagatgctatggagcaggctggctggtatttgatagttccacaaggatgttaatgaagggatgtcagtggctaaaagggtactaattttcattgcacactggctagttaaggatggaaaaggccatcgaaaggaaaggcacaaggcctattcaatgaccaaaaggattctggtttcatcccactggaagactaatggccgaataacctttggttctgcagtgtatagactcaaccggagctgaaatgacccctggatagcatgccgatgggaagtggctgcctgaaagtttcccctgagcaggagtattaggagtatggtggccaaaaggggcatcagtgtgctcaacagctggctgccaattggaaaaatatttcacagcacagaagcaggctagtgcctataaaggcccccatactaccagaatgtgggtagtcctcttgctgaaggggcatcaggacaccagtagatgggcaaactgtatttagatgttctgccccttactaaatcctgtgtgtttggaaacagggatcattggctattagccatcccgtctgatatggaactcttccagttttgcatcatcccaccctctgcctccccagggctcttccggaaacttctgcccatgcactgctgcaaggtccttttggggcccttttggtgaccagatagccctcacaataggtttctaggtgcacttatgaacaccagcctcctcctgtgc

SEQ ID NO: 2114 - DNA, 2600 bp, artificial
  synthetic oligo
gagcaaaaactttttttagaaaaagatatgctctggacttaaaagaaagctaaagaagaaagaataaccatttcccatgaaggcacaaacttttctatggtaagaaatgtgtagagagccaagtacaaacctaaacaaacaactcccctcctcttggctgagtttctgatagcagcccacccagcagaagtggttcctggagctccccaccccaactctgctgagttagtcacgatttcttcacctttgccccgacactctcctgatcactgaaaactcgttactgcccgcgcccctagataggcactgcccgatgcttttgtgagctgggaaaagccggcgcctaaggccagtacccttacccgggttaaagagcacggtccccttgaggtaggcgtactccttggtactgatgttcagactccagcatttggaaagaaagcacttgatggcttggacctgggaggcggagggcaccttcctggcctccgccggcggtgccaaatggtgctgcagcgtgggcacgggcagtggctcgttgcccccggtctcccgccgcctggtggtgaggatcttctgcagcatgctgggctccgagacttccacagtctcgaactgcaagcggtcctgggccagctcaagcatgagcagggacgcccagcagttgcgcaccagcaccagctgctggtccaggggcagcacctggaagcagggcaagtacttgacgaagcgcagcgtcttcaacaggcccgctgaggctgcctcgcagaccacctgtggactcttgagcgccaccggccgcagcgcaccagaggaggtgtcccaccagggggccctcggccgctcctccggagccgcctgcgcttgatttgtgctcgtgggcacgcagtagagggtgctgccctgctgcgggtggtcttcaccgcaaaagcagcagcggtacagaagcgccgtggcccgcccgcctggtagcgcctctttaccccctggcctctgcgcgaagtaggagcggtcccaccacgcgccccctggccgtgcctcgggcgctgccggagccacgtgcgtttgctttgagctagtgagcaagctgtagaggatgctgccctgccgcgggtggtcttcaccacaaaagcagcagcggtacaggagtgccacgggccgcccacccggaagccccgctctgcccaccccgggatcagagccgcacgaacagccccagcacggacccagcgtcgcctcgggcgccttcggtgccgcgtacgtttgctttgcgctcgtcagcatgctgtagaggatgctgccctgccgtgggtggtctttaccgcaaaagcagcagcggtacaggagcgccacgttccgcccgcccagcagcccctctctgcccaccccgggctcatcgccgcacgaacagccccagcactgatccaccagccgcgtctctggagcctcaggagccgcgcgcgtttgcttcgcgctcataagcatgttgtagaggatgctgccctgccactggtggttctcgcccgccatggcccgcggcgcccgtagcccagttctgcccagtggctgcctcctgggacctatttatacctagcgcgcacgcaggcgcgtcggccgcctcggtctgggcaagggcgcggaggcgggcggtgtgtgcgggggggcgcggtgctgcgctccggtgtgttcgcccatgacctcggtggttcgaaggggcgggtgctctttaaaagctggaaatggaagaacagcagcgtgggagctcctggacactttcctccttcctctcattacccctttccctgtctcaggaagaccggaggagagcgagcgcctggatgctgttgcaactctttccattgaaccctcgcatctaatttgttccctttattgggagggcaggggaaaagaggaaacatctacttctatgctctttgtaaactttcattaaattatcacagtttgtgtgacttatatttgtatatggatagggaggtctcattttctgagaccttgaaaaatacagaacatagacaagcatcatatgggaactcggtggaaatgcccaatctcaggctccaaccagactttctaactctgaatctgcattttaacggtgtccccagggattcacatgcacctagacgtttgaaaagcactgctctaaatatgctatcataagcgctcagtttaatgccatcagtatttataagcgcccactatgtcctggatgctgtgttaagagagctgggggcagcgagcaggatgtaaaagtgcctaaaacttaggaatataataattacgaggggataatattgttacagtgagaattgttttcattttagtatatatttttttttcttttaacttttaggttcaggagtacatgtgcgggtttgttatataagtgaattgcttgtcgtgggggtttggtgtacagattatttcatcacccaggtaatagtatccaataggtattttttctcattctctccctcttcccaccctccaccttcaagtaggttccagtgtctgttgttcccctcctagtgtccaggtgatctctttatttagctcccacttgcaagtgagaacatgtg

SEQ ID NO: 2115 - DNA, 1000 bp, artificial
  synthetic oligo
acagcctgactttggagaagatgacctgctcttcccattccctctccagctcccctctctgctgagagtcgttttcatcgctcagtaaaattctccaccttcaccatccttcaactgtccatgtgacctcgttctacttggacatcagacaagagcttgggacccaccaagtgtgggtatgcagaaaggctgtcacactggccctttgccctcgctggcagagggaagcagccccatgtgatgaggcaaggggctaactgagctgctaacacaccaccatcggtggatggtggaattacaggagcactgtaacagctcatctggggcctcagggtcacgggcaccctcaactgggcaccgccatgttcccctccaggcaatacgccttatgtggctgaggaccctgcattgagcttgcttctgtgtcggcgcccagagtagccggctgcatcccatactggctcgcttgtgcctggtctggccacaggccccacatggaacttgttcctgtgttggcacccggggcagctggctggatcccacactcgctcatatgctccctcccacaagcggtcgagcgcagtgggccaagtagagggggcacccccgagtccagggaaagggccgagaaaactcctgcatcagtatctgagggcagtggttgggtgactaaggaaaggacacgaggtgaaaaaaaaggtttcaagaatgaaatgccatgtcaacaacatgaatatggtgagcaggggaggaggtatccaaggaggaggctggaaagtcatcaagggtagaggaaacctaaaaggtcctgagatcttaaagcccaaggtgagagagaacaacaagaagcagttaatatcacaaagtcaagtgagataaagcctgaaaccatgacattctcaagttaaaaaccactttcagcaggcaatttggcagagtccaatctatagcagaggaatcagcagcagtagagagagtataaagctaggataaaataata

SEQ ID NO: 2116 - DNA, 1250 bp, artificial
  synthetic oligo
ccatttttgtccaactctttaagatcttgttgcatagctctatgatacatctagctttgtacttctaactgccatatgcctccacaccttttgcttatccaatgcatcatagctgatatttgttttcctttatatatccttgttgtgacaaacagctctttgactggcattcttattcacatcccctaaccagatgaaaatttttctacttccaaatgctctgattcaataggtctcaattggagcccagatgatatagatacaaccaggctgctatagcagtgaggtgatttactgagaagaaaggtgacaagagttctcaaattctagcaggcatccgaatccccaggagggactgtcaaacagatttctgtctcagggctgacacactctcacacactgcacttgcactactctgagtgggtacctccttacattttgcgccctaggcaacttcctttcctaacattagttccggctctggctggacacacccagggtttgattcagtaagtaagtaggtctgcggtggggtctgagaatttatatctctaacaagttcccaggtgatgctgttgcttctggtctggggaccacactttgagaatcattgcaaccactgctttaggaccttgctacttaaaaagtttggcctgcagaccagcaacagccacatcacctaggagcttgttagagatgcagaatgtggggcaccactccagatctaatgaaccagaatctgcatttgagcaagatctccaggtgattggcaagcatgctaaagtttgagaagcactgctttgggatggatatagggagggtacatctttcttttttcttctttgtttttttttttgagactgagtctcactctattacccaggctggagtgcagtagcgcaatcttggctcactgcaacctccgcctcctgggttcaagtgattctcctgcctcagcttcccaagtagctggtattacaggctcccgccaccatgcccagttaatatttgtattcttagtaaagacaggttttcaccacattggcaaagctgttctcgaactcctgacctcaagtggtccaccctccttggcctccccacgtgctgggattgcaggggagagccaccgcgccgggcctgggagggtacatctttctaccaagggaactaactacaagtaggccccacattttccgaaagcaatcagtggatgtttttaaggttaagtttgtcactttagagcaatgcag

SEQ ID NO: 2117 - DNA, 1000 bp, artificial
  synthetic oligo
agtcactcgtaataaaagcttgacatctgccactgaaggcactgccacattaaaggctctaccttgcaagaccgaaggaacacccagcccagatcaagtttccttttgtcttctttgctccccctggagtggttcattagccctttctcctatctctttttctctcggtgttaaatgtttctttgtttgttgtggaatgtttaatctgtaacactttgatattgaaagtatgctttgcaatattgactgacttgtggagtggcttgagcctgtgtattcgcagctccgactactgagtgaatggcaagtactaaggaaaattgtctcccgggaaactccatgtagcatgtggcttttgtggttgagatagcatcaacgaaagtctgacattgtggaaagacacaaagatgcacagagctggttatctctaaccttgcaccgctcatgacactaggcctcgctgtcttgttgcgcttaaaaccctaggaccaccatgtgaatgagcctgaactagcctgttggaggacaagagacacacgtgtggcaaagtcatccacattgccccagctgacaccgagctatttgcgagacatatgagtgagaccatcctatcccatctatgcctggctgagccaacagctggccacagacacagagcaagcttagcagacatcagggaaacagtccagacaagaaaaatgccccatacctaaccagtaggaatgttgtacttggactctgaggttctgaccgtagcatcagatcacacagagaactaccttgctcgcccgaatgtgtggctttctctggcttccttcttggtcaactgggctccagccaatggtcatgtgctgaaataaagaacaggaaagtactgtgacatggaacattatgacttatttctttttggaatttctacctagaatgcagcttctctaaggctgtaaaatcattgccctgagaagagcagtcaatttttcatgataagttgctattctct

SEQ ID NO: 2118 - DNA, 1500 bp, artificial
  synthetic oligo
ttcaatttcaagtgctctgcagtaaaccaacagtctctatagattatacagaagggtcatgtgttgatttgagccagtttctgggggaaaaatcactaccgaggaacagcaagtgtttaaacaatgaactgacagctgccggtccattagacccctccacaaggccaactcctgctcttttcaatttcactgtgatctgtagatacagctcttgatggctgagctggtggtgatgggctaagttccaatagcacctgcacttatcagagcaataccttttatcagaggactcttacatgaagtcctttataaagaagagaaacagcgccagctaggaaagcgagaaaaataaaatatatacctacttcaagttccgtattgcccatttaagtgcttgtagagttagaagtaaaattttgaaactcttgatttatactatgttctcgtggccattctcagggatatcaggattcatctttaactgaagtttaatctaaataattaaacctcatagtttgctaaattaaatactaatgtaatgatccatgtgtttcttttaaaaaatatctttctggcaataggcttaaaaaagcgagaggaaagaatattttcttcagcttctgtttcaggcaactacaatccttttaatcttctctgtactggagtcaaatgttcaaaatcatcagcccttgcaaatgggaatttggtttaggatttcgcaggagaagagtaaaaagtcctagatgaagacacgcctttgattcgtttaattaaggtctttcctcacctttgatttgattctctgctgaatcacttcttcccttgaggcctttaggatgcctgtattggggatctctggtttaaattttcagttgatgtttacatcttggggtagacatccatctgagcctctccacctgagtgtgggcccaatgcttgccttgagtacatctcaaatttgccaaatcttgattgtttactccattcttaaccccattattctcccgcatctctgatccttaataactgtacctctgcttttctagacatagctttaacctgcagctgtctgtacctaggctgaacctagctaggttatagctctcccagtctgactgaactgagcagttagttccactgaacaatcatttcaatttacttttcaaagatcagttgtgctagttcttccattcgatggattgacttgtcttggtaataactgagcaaattttttaaaaactttaattttaggtttgggtgtacatgtgaaggtttgttacataggtgaactcatatcacagggatttgttatacaggttatttcatcacccgggtattaagcccagtatccaatagttatcttttctgctcatctctctcctcccaccctccaccctcaagtagcctctgttgtgcccttctttgtgttcatgagttctcataatttagctcccacttataagcgagaacatgaagtatttggttttctgtttctgtgtt

SEQ ID NO: 2119 - DNA, 1000 bp, artificial
  synthetic oligo
gaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggaga

SEQ ID NO: 2120 - DNA, 1050 bp, artificial
  synthetic oligo
attatattttgtaaattttcagttaccataaatctctaaatgctaaattttcttctgtttggttgccaattgtaattcttagtagtaaacaataggtcaaaacaacatgcatctttcatcaattttgggaaataaccaaagtataaaaattattataattatttctaaatgagatggatgagttacgcttttgttttttcaattgacttattatgtatctgtagatagatattacttattgctacagtgagtcaaaacacaatattctgttttttttctcatttaatagggataagtgctgagtaaacctcttcataaacaaatagatgataatacagttatgatgttacagcaatgtttctcaagtctttgtacttttttttttttttttttttgagacggagtctcgctctgtcgcccaggctggagtgcagtggcatgaactcggctcactgcaaggtctgcctcccaggttcacgccattctcctgccttagcctcctgagtagctgggactacaggcgcctgccatcacgccaagctaattttttttttgtattttttagtagagatggggtttcaccatgttagccaggatggtctcgatctcctgacctcatgatccgcccgtctcggcctccgaaagtgctgggattacaggcgtgagccactgcgcccggccactttttgtaactaaatgaggccttcttcaattttgttgtaagcaaataattggaaatccctcaaattgcaaaatgctttgatacctagtcactggtggaattaatttccttaacataagcagtaattttgcaaactgttgaattgttaaacctataggtattaaaccactggacaactctaatataattagtcaaagggaaggctttcttttataaaataggaaaatagtgaaggtgaagaggaagtgggaaccaagatgatgccttcaccctgtgaaaggtgtatgctcacttttactcatacaaatccattttgggacagacaacacatggtatttcaggatacggtaattgctttgctttaaaat

SEQ ID NO: 2121 - DNA, 1000 bp, artificial
  synthetic oligo
gtgagccaccgcacccagtctcaacattcttattcaggtatgggctatcaagtattaaatgactgagctagacactttaaataaaagacgaacatcagtatagactttctaaacaacaacaacaaaaatttcctacatgttattttccaactttttcctgctgttactttgttgcagcctgcttaaagtaactacttgtcaatgctctcactctctcaagtttattacaagaaaaaatgacatatctgtatgtagtggtggctgtcaacttgataatttcccaagctgtgtgcaccctgggtgtcagattttcctaacattgaggctatttacatgagaactaagaagcttctcagaacaagattatacaagaagggtgagaatctagccacatgaattgaattcaagaagaatggcttatattcggaaggggttggagatttggatagaactcaatgcgaataacacatataccacccatccccagtcttctgatccctgtggcagtccaaagtaacaatgaaggggaagtataaatttaaaaaaaaataataacctcacccaaactctaaagatattgagagtataaggctgccatgctctacagccagtataacagggccagtcagagtggggacaaagtatatcagctcccattcagggtaatattaatggcaagggttgcatctgcaagccagagggaatagaagtgaactccaagaccttgaccacggcatggcacaggaagtccatatcacagccagattatggaaggataaaatgacagaacaggagtgtaattagttgccaattcaggctggaagaaaacagcagatgctatggggatagcccaaagaacaggtgtaattggaaggtattttaagtcagttagagattcacattcctcaattactagaggaaaagagaaagtaaacaagctgttttctgtgctttttatgaccctatatttaccctcaagctcttgtaacctaggggtaag

SEQ ID NO: 2122 - DNA, 1350 bp, artificial
  synthetic oligo
gcttatgataaggagtccatgcaacacccccatgagatacatttttgtcccaaactaattccaagctttgagtcaaagccctaggaaagaaaactggatctaagggatccagaggcagacgacaacggaggttaaaaggcacagtgcacgtgagtgtggctgattcctgccgattaagccaagcccaagcttcctgtttcatggataaaggccacattagtatccatggcataaatgaggtctagagaattcaaggctaccgatagcagggaagatagggcatacgtgggaaggagcagatgattcccacccgttcgaccccctgcttcatgggtgcaagccgcttttacactcatggccacatctgccaaggttgacaggacttggggatgcaaggacagaagaggcaaagaggactctcttccctgtctctctcacgtacctcgggtatctgtcaggcagagaagggaaccagggatgcctgctcccctctttctagatgggtagccattcatcttcagtctgtacccctttcgaatgcatcctgaacccctgggactcctttgaaaaaaaaaagtatcttattttttcttctctcctcctctgtcctctcttcactaataggtaattgtgtccctgtactatggagcacttccctcagatgcatcctccaaactggaaagagttaatttcccaaactttaaactggttggcttggggttaggctcaggggagggggaaccgagaagcccaacatactggcaaatgggtgaagtattttaccagctgggaatttggtctccccgtccccatgcaaactggtaaaagggccttataagttttgagctgttgttacccttccccttgtttcgttttgatacatgtttccttttttcttttttgaggaggagtctcgcactgttggccaggctggagtacaatggcgcaatcttggctcactgcaacctccgcctcccgggttcacgtgattttcctgactcaccctcccgagtagctgggattacaggcacacaccaccataccgtactttctagatgggtagccattcatcttcagtctgtacccctttcgaatgcatcctgaacccctgggactcctttgaaaaaaaaaaagtatcttattttttcttctctcctcctctgtcctctcttcactaataggtaattgtgtccctgtactatggagcacttccctcagatgcatcctccaaactggaaagagttaatttcccaaactttaaactggttggcttggggttgggctcaggggaggggaacccagaagcccaacatgccagaaaagggtaaaattttttaccagacgggcttt

SEQ ID NO: 2123 - DNA, 1050 bp, artificial
  synthetic oligo
ctactaagccatgaaatctgcagagttaggaggttcccacatctgtctttgcttcccacactacaccatgccagcgcttagcacattcttctcctttggaaaggagtatagtgaggaagaagcaacaaaagtgggctaggaaagcaaaagaacaaattgttgaaggtatctgtgggagtgaaagtggcgccaactcccaactactaatgtgaaatgcctttgggcagcatgctgcctcaatgctctgtgtgaggcccagggttcaggggcatggccacaatgagcactggttaataaaggtgtctaggaagccagtctaagctctttcaccagagaagtagatgatttaatgagtccgtaccagactagatgatttccaaaatccttgggaatcctcactattttgtgcggtaggaattgtttttgttattgtacccatgagaaatctgttatcctaaatataaagcccttgcccaagacgatacagaattcaagaattcactgtcagggctgatgctcaactagaactctgggaccacagtcaagttttcaatgaaatgctgtataattaggttgctgggtcatataatttctcatggcctctctctgctttagtgagaacaaagacatgtagagagaaccagtaagtagctgctgtgattccacagcaacataaactaccgccctctcttgccaagtgttcctgggacagccctttcttctggcaaggtcaagtttctcctatgcaacttcacagaacaaataccccttgttcaatttctactgggaaatgagtttaagtaaattgtttttaaaaatgtgaggctatagtatgagatagaacacagcttttcctcaggaggctgccaagcctctcttcatggatgggatgaggagtttaggctttttatctctcccctgatgtgctgatccctactttaggattgtgattaatttaaatactgtgtgtctacattttaggtgacatttctttataaagtgttggtcccccacccttgtgcaatggggataatctgcattgaactataa

SEQ ID NO: 2124 - DNA, 1100 bp, artificial
  synthetic oligo
cccacacccgcccgaccttgtgcgctcctccccgcataaaggtctccaccgctcacttccggtcccttcgcagagcctgtgaccacactaccaccgggcccgggggacgacgccctccaccagccgccgctgtcgtccaccatggtggtgctccgaggaccccgccgctgccgccactgcccacgccgatgccactacccgctccgggcccctggcaaacccactgcttttcccctcctcccagcgcccgcgctgcccgccctgggcccgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctcaaagcaataaaggtgtccagctgatgcgtatctgcagcactctcaccttttaggaatcagggcacatccccatgcaggtttaaagtaggtattcagcagtctttccattcagccctgccccatctgcatgcagctcaggatctgcgggggtg

SEQ ID NO: 2125 - DNA, 1050 bp, artificial
  synthetic oligo
gcatgagccactgcgcccagccctaagtttcaaatttaaaaattcacttaaaatttccatttaaattcaatatggtatagaaacataatattataagttaagatagcatgctgtggacttcttatttcagcgctaacatgtaaagagcttggaaagttgtcactcccatccttatgacaggaaaaggtgaactaaaaatcaatgattttttcttggacccatcagagaactgaagtacagggcaaaccatcaccctgaaatctggagagatgggtgaattaagagagtcacagatgaggtctgttaaccaggagcagaagcagctagagccataaaacggtaggaatacttaaatggcaataataagaaattgctagaggtagagcgtggactaaaatgaaaggaagaaacttctgggatgcagtcttatggcgggggggtgggatccatattttcttgagatttacctccaggatccccaccacatacttatgggaaaaaaattgagcatgatctcctggtggctctggtagggtaaaaggaagagcaaccatcttgaaatatgcccagggtattgtatatgacaaaggcctaatctccaggggaaaagacttttaaccaggatcttattccaagttaaggaagggcatttttcctactccattcccttctagcatttctctctcacaagaggagaaaaataaagccaggaaacactggtgatggtcacagcacaaaggtacaggcctattaaaagattaagatttcatcataagtttgtagaatgctttccctccccagtaccttaccaccacaccaataggagtctagtaaaatggcagtggattttagctgaaatagcagcaagatgcagactctttgaggagtattagggaagcccaaagtcaacaggggaggcaaaaacaaaaacactagaggaatttgaagcctcagacacctatagctacagcaaacattaaacacagaccaacttctagccaggttaacgtgaacatttacattaaaggcctatttgacataatttctatt

SEQ ID NO: 2126 - DNA, 2200 bp, artificial
  synthetic oligo
caagcacactgctagaaagatgggcatcctctatccttctaccagaactcagtaggttcatttctcataccctagatttaagctgcccacggtgttgaacgcagagccaaatatttgcacgccctatagccgacgtcacccactttcccattaacactaaattaaaacgcatccatggatttcctctccattccgaggcaacaggagtgcatggcacattgccctactcccctgaagctcttcgctaacctaagactccagggtgaggaagttagctggagctttttaaagtgcatctccaaagagaattttgctcacaccatgagagcccccaagaaacaccagggcccccttagatgccggagaccacgccctccaggaataagccgcaccctctgcccagcagatccttgcgcgagtagccctctttccctggggctaatcaagtgcatgccacatgtcaccactctcagctggcaattcttcctcagaggcgcagactttctcggaatccccagcagggggggttaagagattcaggggaggccccgcccgtgccttccacaaaagtcgctttaccgtggctcgtgtcctgcggccccaagggggtagcctgggacgtgtagtgggagggcatagaggctccttccaggacaagctgccagcctccagtgggcaaccatgtgagaggcaaaattctgggggtgagaaagtagcaaactagtctgcggccaaactttctctgtggagcctcctacaccgaaaagggtttgattggaactctggaagcccggacgcagaaggtgctagggctcccgtcgccgcgagggcgccccgcgcctggagatgggatggtcagttcttcccggcgcgtgcccagacaccagccccgatccgcatcatccccaccctcgggctgcgaaagaggagttctgcgcaaacaaagggcgcccccggcacctccctctatcccgagcgaagggtcccaacggcgactccgggggtctttggtgcccagctgaggaggcagccacgcctccgatcctacctgggaagctgcggctgggcgggacgcgcagcagcagcagcagcagcagaggcggcagcagcagcagcagcgcgggccgatgtgcggggctccccatggcgagcgggcgcttagctcgcctcggcagcgcagcgcgcttcccgggggcggcaggagaccgaagagaccaagggactgcgtgctagcgggcgggcgaaggccgggctggaaaactcctcctctcgcctctttccctccctccttcctgcctggggcctgccctcctttctccgccccccctggaacactgcgcggttcggggctctgacccacccacctcctccttttgtgccagcgctttttctggccagagagcgctggagacaagccccagcagagcgaaatatcctgaagtagctttctttgccccaatttgcgcgccccctcacccggaatacacacacggtattcaatacaaccgcctcgaacatcccagacgtctagaaggataccatctgtgcagaaagctgcgtgagtcacacggaaacagaaggggcaaccgaggggattcagagtggcccactgcggccggatactatggccatgttctctgttttgatcctcacgaccatgccccaagttcgctattaccatgtccactttctccaataagacaccgacgcttagaaacttgcccagattcacccccgttactggcagagcagggactggaacttaggtgtgtagttctgccgacgtcaaagtccatactacagattttttgttagtttgtttctcttttgcaaaggaataaatcaaggactggaccgggtgcgtgcctgctctgctgcggtttaggatggggcttgaggttctccttccaggatcagctgatgggagagcacaaggcacagaaagttctctgtctcacccacagccatggggatccagctgtaggttcctgcagccagatttcctcatttcctgggttgttctcaaccaccccaaagataccacgaccagactggagcctcttccctgtggcttggcatcgctggatcctggcatcaggacagggtttctaggctgcccgcaggacggatctggtttctttgaggcatttgagtaagcctctcatagttttgtttgtttgtttgttgttttggttgttta

SEQ ID NO: 2127 - DNA, 1200 bp, artificial
  synthetic oligo
cactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgcc

SEQ ID NO: 2128 - DNA, 1200 bp, artificial
  synthetic oligo
atttagcagttaaggaaaccaaggttgaaagaagtggctagactagcacaccaattttaggcatgttaatttgactacaaaagccatgcttgatttacattaccacacacacaccagactgccaaccagattagcccagagggctcagtaagttcagatcttactcttgtcaactgctagaatataagggcactgagttaagagaagggagatatcaacgcagccttaacacataatagaagcctgcacattcattctttgataatcagtgaagccatagcaaaattaaaattaggaaagttgctagtaaagaatcacaatgtataaaacccaagacgtgaaacagtgtttcctctccctaagtccttagctgctgctttggactttaagctcacctatcaggtgaggacagctttttccagtattgaaagagctcctataatgtttgtggaatgattgaatgaaaaaacaaacttatattcagaagtcccaggctgcaaaacaaggaccaatagttagaaattaaaagaaggcagctttaagctaaaaggaaagaaggagtttctaacaagtggatttgggtgactgtggtagcttcaggatgagctaagttctttttctcagacatgcttaaacagagatttggaactactttgctagttggcattgaataaatgttgggttggatgatctccaggggtctgaaagcatctgagagtccatattttgtggcaccaacagtaagacaatcaatagttgactggactctttgacttttctaacctgtcattgtgcaacccctctggttagtttgctcatcatttccatcaatactaatggaagctgcagtgagcccgaatccatcttcagctggaaacagatttagctcttacctgagccaattctggtctactactcaatgccaaagaaagattttgcggggtgagacaaaaggcaaatgagtatgtatggttctacttgaggcacggacaatttaaagagaagagcgggtggaagccacaaggaggcaggactgtctgagtcctctggaggtagtgacttgtgcctgagaaagtggctcagctcaggtaaactatggatggagctatgaaaggacaccgatgttattcagaaggtcaggccattacctctttttaagatgccttacaatcaaagactctggtttttaatgaggagcca

SEQ ID NO: 2129 - DNA, 1150 bp, artificial
  synthetic oligo
aaccaaagctgttctgtcctctcttcctccttcttttctgttccctttcctttcaaacccttgggtcccatttcccctcctcctcctcctctttctcatagccttccctcttcccttccttttctccttggcccctttctgccaacttcatttttcttcctctgtctcctcttctactcactccccttcaacttcaccctgcatcctcacttccttcctcctcctcccctttctctttcctccctctccttcccacccactccttctcatccctctcaccttttccccttcctttccccatccctctttccttctttcctctcctttcccatcctttctgccctatcttactccatttttctctcttctctttctccctcctgctccctccatttccacccccaccaccttccttccttcttctctctttcatcctcctattcccttccttcttttctgcaactttcctcccctcaccctctacccctgccttagaggactgccacccttgccccagtccccgcccacagatgaaccaaggtctgtcctgagcagctcagggcggattctcctgtggcgcggggaaggcggcttgtcttgccctctcagggcgctgggtgtttccaaagggcggtacccgccctcctgcgccagctggggcgggaagggaggctgggtgggggctggcgggaggccttaagtacgggaaccacacgtggcgcgccggggccgcggggcttccagaggtcccagcagagccacagacggtaccgggagccgcctcggtgaggcagtctagctcgccggcctcgctcgctgggggaaggcgaagaacacgagctgagtgggagagaagagcggctggaggtgggggaatcactttatcttgattcgtgggaacagccttgccaccaggcagcccaggccaccagatagttaaaggaggaatgctttgcggacccgcgcgtctgcgagaagagaaaaggaagccgcgatgcccggcgctgggagcatcagtgccacactcgccgccctttgaacaagcagcaaagcctggggtcttgactcccttaggttctctttattgcggcaggcccagtgttcccccccggagtatttcctctccatcacgccggccttggtccaaagg

SEQ ID NO: 2130 - DNA, 1100 bp, artificial
  synthetic oligo
agcagggatcatgaggctgccctgaacagtagctgcatttcccccagaacattccacaagaccctcaagcaggcaggccaccaccacagctagatcccacccatgtctatgcattaaaaataagtcccatgaacaagcaaatcttccagttgccctggaagtcacaggctggctgctcctcagtcacagtattaagcccctctcattccatcccacacctccctgcccctggtaggtctggtttcctggtttgagagggatttgggataatgtctctgcccaaaaaacctcttctgctcagttttacccacaaaccttttaacagaagatgagtcttttattccacaatatagagatgaaacttgaattgcaaataatcccaggggaggcaactcctttatctgaattcacaccaaggtataaaggacaatggaaagaagagtgtctaaagggaaaaggaaggggcactgatagagggaggggagaggagtaataaggcagaggagtgctgaatagaacagctgtgatagattaaaagccatcattttcctagtcccagccctgattaatacatataggtacggtctaatgtgaccctgttggcctggactcatggttctcaaccatggccgtactttacaatcctctagggagcattaaacaaaaaaatgatgcctgggccccaccccagacctattaaatcagaatctctgggggtaacacctgagaataggtatatttttaaactccccaatcattctataggacaacctgagttagtgtattagtcagctattgtcgtgacactcccatgtaacaaacaaactcccaatcaccagtagcttacaaccacagacatttgtttttctcactcacagatttgcagatcagctgcaattcagctgatttcagctagcaccatcggactcctctccagattgtaaactgggtttagatctgctgtactttggtcatccagacaaatggctatgcaggagaagttctctccagggtgatgggtggagcataagaggccaagccaaaccatgcaagcacatggaaagcctcagtgtacatcacagccattaactttccactag

SEQ ID NO: 2131 - DNA, 1000 bp, artificial
  synthetic oligo
tcaaaggcccaggtggaggccagatacctggcagaacgcattatattcctgattctgttaatcagggttctccagaaaaacagaaccaataggagatgatagacaaactaaaatagatgatcaatagatgttgagatagatagatagacagatagatttatcataagatactggctcatgcaattatggagactaagaagtcccacaatctactgtctgccagctggagaccaaggaaagctgatggtgtagtttgaagcctgaaagctggacaggcagtggtgtagattccagtgtggatctgaaggcctgacaaccaggagcactgaaggcagaagaagattgatgtcctagctcaagcagtcagacacggagcttgaatctaacctccctccacccttttgttctattcaagtcctcaataggttggatgatgcctacacacattgcagagggccatctgcttgattcagtccaccaattcaaatgctcatctcacccaggaacatcctcacaggaacacccagaaatagtgtttaaccagctatctgggcatcccatagtccagtcaagttgacataaaaaattaaccatcacactgacaaagtcagctactggagcagttagaaaggagaagtggggagtgtcattggtatggtctggcaaacctgggaatcacaccattgatgtcactgactgagcctggggcttcctcctctaaaatagctgacactgtctgcttctgagctcttaagcatctcccaaggttaacaacagatgttcccacagctgattcaaggctgcaaagcctaggaattcttattaattcatcctggggaaataaaccaagatgttactcaggcaaatgccaacacctctgttaagaggtcatttatggtgataagagaacaaacctaaagggtccaagggctctagttggacgaattttctaaaaaatttagaggactgttctagaggacagttggcagattgcaacata

SEQ ID NO: 2132 - DNA, 1650 bp, artificial
  synthetic oligo
ggtggctcagaccaggaggcacaggagaaggtggaagaagcagtcagactatgaatgcttccagggtagagtcaacaggcaagcgtgattgttccaggaatgggaaggggagtaggtttacccacttttgccctttcccctgctgctcctcaaatggggatgatgtgccctaaagtcattttctggatgcctggcccagtagggatttactggccctggaagtccaccctgtcagaaattatctatgtgagcctcactgaagaggggaaagtgtctgttctcaccaaagggaggtcagcagttagtgaagatggaagagattctccctgtagcctgctccctatttactcactgaaaagttccagtggagcccagagctgtttctgaagccaacaggcagaggtctccttaaacctaagtcagacatattccctctctgttcagagccctcctgtgatgccttgggttgagatggggtctatacccccctcttcttgaacctgggctgaccttagtgactctctgctaacccatagaatgtagcagaagtgacactgcaggacatctgaggacaggccatgtggcttccaactggctctcagaacactcaccccaaacaatgccagctgccatgcagtaagtccagccaccctgagaccaccatgctggagggtccacctgtaagttcacttgtcaacagtctcagctgaactccaactcccccatgcgtgcatgcaccatcttggacatccagcccagttgagccttcggataactgcagccccacctggcatctgactgcacccccaagaactgctcagcagagcccttctcaaattcctggtgcacaatactgtcagcaaagtaaagccttgaaataagttgtcacacagcaatagtaattgaaacaccattgattttggagccctgctgccgaggagccgtaggtaggctagaacggatgacgcatgttccctactcacatgcagagaggcagctgtcacaagaacagcattgtgccactgtggggttcttttcttctccaggataacccccattggccactcagggtgatggggcctttggtgtcctgggccctaaggaacaataaacattgctgagttttttatctttttctttcagtcagcttctctatgtgggtggcagcatgggaggggtgggtcccaaacctcacagtgtcacccccatgggctgagcagtgtctgatgcaaaacaaaaagtgggggccacgaagtccaacgagagagagatttatgcttcttactccccatctgcaaagcaaaacaaaaatagctgaaacgctggttttctgctttatcggctctgtgaataagcatataaatttctatgacatttttggaggcttgctgaaggggaaaaaagccatcccccaggacgcagccagcagcggcggcagcatatggtttgctgagagcggaggcagagtgcttgtatgtctgtgagcactgaaaaaggtgactttgtgggtaatttcagactcaaggcagttttcacctttttaaaaaaaagttccccttttttattaaaaagatagtcttgccaaagccaaggtaagtgcctcagccagtcagtcctcagcaggaaaggactgtgctatacaccctgggg

SEQ ID NO: 2133 - DNA, 1300 bp, artificial
  synthetic oligo
gcagaggacaaccagcacacatctgtaccatgatgtttgctctgaaaacactctggacatcagctgttcctttacaacagtggttcttacacttgaacgtgccccagaaccccctgcagggcttgttaaatgcagatgcctgggctccatccccagagtggctgattccatatggggcctgagaatctgcatttctaacaagccctcaggtgatgttgatgctgctggtctgggggatcacttttttaaaaattttttcttttttttcagagattgggtcttgctatattgcccaggctggcctcaaactcctgacctcaagcaatcctcctgcctcagcctccctgagtagctgggactatggtcacatgccaccatgcccagctagggaccacattttgagaaccactgctttgtaaaacaagattcctggaaagcagcttcccttcttccagaacacaggcaactcagaactctccatggccagccatcagcagcccccctcatctgacagccacaggcccaccaaccctacactcaccctgtccttcctcttctccaggtctcatcttctgcctgatccctgttaagcctccagggcctgcctgcctggttgctccactgttgacaccacatgcgtgtgcacacaggcacatgcacctgcacaaacacacagtccgattagctgcacctggatgcctggcccattttctaggggaagatgagtcaaccactccttggggccctgtaacatgcggtgctcaggccaagaggtcacgattcctggtgacatgacattgcctatctgcaggcagccctgccacacagtggcttcccctaacatctttgtgcgagaggatcatgcctggactccaagccatcccggtcttatgaaacaaaaatcgcccgttctgcatcagctagatggaattggggttttccaccacggacaacctaaagcaccctgactgaaatggagcttgggagaaaatatcttccccgtggggatttttacaactatcaccacaaaatgggatgcttactcagtccaaaaagggatcagtcttctcatgattccagggagggaggagatgaagcctgatcagcccctaccaagccaggatgtacggcgtgtaaggtgtggctatgtcatgttagattcatacctgcagcccagctgtggggagtctagcccctgggaatgctgaactagccctctatccatcttccaggcctcaggtgacctactcagaaaattccccaccactactgccaccatcataaagcccaggttgggtct

SEQ ID NO: 2134 - DNA, 1550 bp, artificial
  synthetic oligo
ctttttccatctctgtggctttgggacatgtaggcacacacaggtgccaggatttacctgtgccgaggaacctgcctgccacactgtgaccaggcaagcattggattgagggtaaacagattaggattccaaaatgggggctttggtcagcacctgagtgatcttaggcaaatgacgtggattcaccaggaaacttcatttccacagctatggtgatcatctgattcccgtgatgatctggtgcccctgatgtttgatgctcttctttgccacagcctgacttcctgtccaagatgcccaaggcaaaaagtagactttttctctgcttgcaaagtgatttgtggtctcagctcaaaagcctgaaaactaatgtttgcagccagggggttggaatacctgaggactgcttaggtaaacagtcctaccagactgcctctggagaaggtttttggtggtgagcagaggggcccactcgaggtctgcttgacctgtgcctgtacctgcacctgttcacgacgaaggtgcagtctcagcccccttggggagaggatgcggtcattggcagtgccccctcagctgcgcgctgtgggatctaaccagtgataatgctggtaaatgtttaactggctctctgggggaaagtcctaatttctagtttttgccaatttccatagagcaaaccctcctactctagccaattccaagcttcagacttgtcatcactgaacacagaggtaggaagagctgtgcacagttggctgggctcttgtgcgctggagccggccccaaaacacccctcactgggtctaaccctgtggctgactgaggaatggctcctcatgcatggccagagactcctgagtacacagggccaggccagggagcagaggaatcaaaaggatggggcaggggttaggggcttcgactggctgggttgggggcctgggaagaacatgtcacgccagatgccacatcacagctcagcgtgttgctgcacagtctggcccagcgtgtgttcatgcatttgctctgtctctttctagagacattctagaactcagtgcttacatctggcagatgctcactacatttctaattgagaagtgtgtgcgtgcttagatccaggcctttcccccagagacaatagagacagagatacccagagagactgactgtaaagactgggccacagcctcggcagctctgagctgtggcagggattgcagcgtgggagctggaggagtagaatcgctcggggaagaaagacaaggttcctattgagttaggatgagaggttcacaaaccagaagtggttataggggctccccttctatagagactccttggagcaggactgaggcccctggaagctaaaggccattgcctggctgcttgcccccaggcaaccttccccacacctgccccctccccacctctgcctgactgaccctagatcctttttcttttttcttcctttcctttgtacaaaaagggaagagcaagtccggctcaaacgtgctactctccaggaattgccgaaacttacactg

SEQ ID NO: 2135 - DNA, 1100 bp, artificial
  synthetic oligo
ggaggcccagttccatttgggcccctccgggagatggtgtggtcactccaggacacacctcagacttctcccgctgagtcgtaatgaaaaggagatattgatccatcatctccactgcctcactggttgagagtcagacctgagggcatttattccccagctgtttcaatgccatcatctcgcctgcaagccacacctggcagagatgctcagaaaaccatctgcaggtacaagaactgtctgcaggggacctctggggcgggcagagggcacatgggcaccaacagcacctgctatagatctgaatgacttttgaattgtcagcgagaaattaaatccatgtttggatgataaagattgctatcagcagagatctttagagaaataataataatagctgaagtttattgagcgtttattgtgtgccagctgctgttctaatcactttatatgcactaacccatttagttctcacacatatgtataaaataggcaccattattatattcttttgacagataaggaaatggatgtgctacaaactccaagacaattccacaaacattttggagcagtgaacccatcattggaataaacaaacagccatccaggtgatagttttaagaagataaattagattggtgtatatataaatatatgtatatgcaaatgcatttgagtatgtttggtaaaagcaaaactagtctcatgatttatacatgaaccaatgaataaccaattgaattttggccaccctaaaggcccttggagttcagaagcaggaagagaatgtgctagaaatatcaagggaagctttatggaaaggacgggcctagagctgtaattaaaaggtgaagaaatagcatgaaataagtcctaaaggcaggatgaagcagagtggggaggggaccaactcatctggcatatgagtcaagatggcaatggcaatgttcaccaaatatctccagccctcttctttcccagcatatggtagaattatattttcttgcccctctttgaagtcaggtgtggccatgtgacttgatttggtcaaggaaatgtcaccagaagttacttgtgtcctgtcgaattggaagcac

SEQ ID NO: 2136 - DNA, 1750 bp, artificial
  synthetic oligo
actcctgcctttaacacaatctatcaaactggtcacgatatgacaggccagggcagagcctttcttcacatcctgagactgtacctctgacgtcctgggtgaaccaggctatcccagctctccccaggtgcccccgtagctgagaagggaggagaaagtgtttgggagatcaaggaggatggactcaccaacagacaaggttctcattttcctaagcgctgcagctctacagttccttatggaaagcccctctaaactgattccagtgccacttagaaaatcagtccctctggcctttcccttctgctttcaggagggtgaaggctaatcatcaaactgattcaaaagttctgaattctcagagaaagcctgaacagagaccagaatgggtgttgcatcctgcctctcctgagcaccacattggcctggctgctcaaggctgcctggagaccaccgtgcactgccctgatctgtcattcaccaggacagccctgctcaacctcgtgggagcagctcacccacagcctcctcaccgacctcccgggcagcttgtcggagccgtctctttgcctaacacagaagctttggaatgaagcagggagagaaagacgtgagtggcggcggtgggggacccttctctgagcttattaagaatcttttgtgcgccatagaataagtccagtcttgtccgtcctgctccccctgcacttaactttttcaggcctgatgagcttaaatgcttcagttagtccatgaaaccaaaagcactccttggcctttgactgtgtctgggtttcttttatgtggccatcataattagacagtggcccgaccccgtggccggaggtgcctgctctggcactccacagccctgtcctgtctctggagactcacacactgtgccagactggaagaacagtctggaaggaaagcccgttgtcaaacaaatcatcgttctgggaacacaaagccgcagggaccctcggggtgctgctgacacccgggccggcagcatcagagagctgtgtctcctgtgtggcgctgaagccccaagtttggagacagaaagctggctggtggccaacagcagcagcagcagtggacaccttatctaaacaaagggagagggcaccaagcgtgaggggaaggggtaggtggacactgcgtgggtggtttcgtgttgcaatttttttttctcttttgtggctgttgttttctttttcatctattcagttttgtagtattcaacagccgggcgcttggcaaaacctggcagcgttatccacacggccgttttcagtccaaatggctcctgtcaacttttacagccccgcgctaaaactccaggcacgtctcttattgccagcacagggttatttatttgcccggactgtctggcctcacatttttcacgtgtgtgttaccccggcagttgcttcaacttccctctggcccttaaaacgctagtaaacgcccagtccaatttagagctgggaggtgttgagcatttcatcttttcaggatcctgcactggttaatgtcattttcgtctccgttcagcttttgacctgaaggaaggggaagccttctccactgtgaaaattactctttcactggaaaccattgttactaataataacctcaccaggcacaccatcgaatggtccggatgccccctgcccgcaggggtggggcacacacatgactcagaggggacatggctggcccaggtcagcgggtgagggccaca

SEQ ID NO: 2137 - DNA, 1000 bp, artificial
  synthetic oligo
gtaggggggatgacaaagaatttgcaaccatcgctattccaccccaatcagaatgatcccaggaaaggaagcaaggaagccagcagagaagggaaggaagccaagaaagcttatgtaatcaaggcagctgttactgtgggcaactggggctcaatcctaccagggatctctgggagacggcgtagaacacgcctcaaagtttccccaacagaaggatgaggcagctggagtatttatctgctgatccccccgtcacggctgcatttctggcctgccctgcgtgctgaaagagtgcacagccagcaaaactccctcaggccgaggcatgggtgtttgaggctacaggcaggcgggtggggcaccaaaagtgtctgctacaaagagcaggtcaagacaagccaccaggaggagcagagatgtcccctggcaaaattccaatcccacaggttgaaccactagcgagggttgcagggtacatggggctacagaaatgaaccctaggggccaccccacaaccatgtagctagggaaccaaggcaaccaagctccaggatgaggcttaagggagcagcttcccagcctgggaagacagagcggggcagtggggagctgggtctgccacaaccacatcccctactgtgggggctaaagtccaagactggagcatggctgggcctcggcgttcaccctagcagcttttcctgcccaaaacagttattctgacccaagtctcaggaaaaaagaggaggcgggaggccacagagaagcaggctgaatgtttttcgctctctgtttgtcacctccccttgctcaccccacaaaccctcgcaggctctcatggcctgcaaagccgcctgcagaaatcacagccatgagtttctcatgaatgattttaagtgattcttgctctgtccatggagggaaatcacttattgaaaatccagcaaaagcctggccaactgagggctgctctgacagcatggccactggcgttcaaacc

SEQ ID NO: 2138 - DNA, 1300 bp, artificial
  synthetic oligo
aggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtgtgtgtgtgtgtgtgtgtgtgcgcgcgcgcgcgcgcgctcgagtgccgggagggcagttgcgaaacgggctcttggctgcagcgcggcataatggaggtggctggaacaatgcgcgctttgtgcgcgcggggagttgttttccacccgcctcgccccccttgctcgggccgtatggcactttaatctccgccacgactcggcacaaatgcacttgtgtcctgcgggtcactgggggccgtgcggctggagccgcccccaccccgacccccgcggaacccaccgccggctgccccatcttccttcctgagcaccccccaccaccacctcaattcccggcgtgggccggtgagctggcgtggaagcttccgggcccgccggccacttttattttccgtgaagacggcccctcccccgctccacgagcgcgcgcgcgcacacacacacacacacacacacacacgccgcccgcaggccccacactcaccgccctctctcgcctagcctctcctcggcccgcctccgcccccgcccccgcccccgccccgcgctccggactcctgcgaacaatagtaaatgtcaacagattccgcgcggcgagtgtctgactcggccgagataagggtgcgcggttggccccgcgctcctcgtcgccgcggggggagcccaccctgaccccggctggaaggaaccggctgtgactaaacccgtgccgggagaggggggcgggagggcagggcaccagtcccagctcggtggggcagcctcgccaggagaccaggccctgccccgcc

SEQ ID NO: 2139 - DNA, 1400 bp, artificial
  synthetic oligo
gggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggcttttgtttctctttcaaatacggtgttttaaaaaacagcagcaacacgccaccccaccccctcttcaaccaagccttctggtttaaaaaaaaacaaaaacaaaaaccaggaggagaaataatctataggacaatcccccccctactggtcggagctggcgttggggctttttacgcagatcgagtcgcccagggctgcggaggtaaacaggctttctgcaccgctgctaaatgaatcacgagggggaagaaccgagactgctgggcgagggaggcctcgggatctgggccgggagccagggcggggacggcgctgcacggggggcaatgaggtggagacgggaccagggttaaccctggtccaaggccccaaggccagggaagggagagtaaggccggtgggcggtccagccggaggcccctactcgctatctgcgaggcagggtgaacgcgcagcctgggcctccatccccagcgcgcctgggcaccacctggggccggtcacgctgcctgagcccatctgcg

SEQ ID NO: 2140 - DNA, 1300 bp, artificial
  synthetic oligo
tgggatttaatgcaaaaaattatttacacatataacagagaagccgaaaaggcaaataggagaccgtgagacaacccagagataagtaactgcaggaagcttcaatcgccctaaagctggaaggatttcgcgaagagccaggtcactggaccccagcagctggggtcagccggcagaagctagagatgctgtgagcctgtccactgggatctggggccacagaggagctccagctgctgaggccgaaagccaaagagaagaaataccctggcttttccctccctcctgtcctccagtctccttctagtgcctttgactgttgaatgcagctagatgccaggaaacatgtagacaaaacagagaaggggaagagcagggagggggcatctgagggcacgaggcccaggactggcatgttggtgttgggcgtgtggcagatcttatttttccaaaatgaccaaacaatatttccagccctacatgttcatttagaaccatgacagtcttctaccgtgtcaggccattattgaattgttataaagaaatacccgagactggatttacaaagaaaaaagggttaattggcttgtggttctgcaggatgtacaggaagcatagcagcatctgcttctgggggagcctcaagaagcttccaattatggcagaaggcaaaggggaagcaggtgcatcacatagccagagcaggagcaaaagagagagagagagcaggggttagatgtcacaccacacacttttaaacaaccagaactcactatcacaaagacagcaccaagccatgagggatctgcccccatgatccaaaaacctcccactgggccccacctccagcacattatcctgtctcttggcatccaatgtttttccttcagagcattttctcaatttgtaattatatatttacttataaggtaatttgttttatgtctaaggttaagaactgtgcctgttttatttaaatcaagcatatacccattgtctagcacagtttaggcacccacgaaatatgattacaattcaacatgagatttgggtggggacaaatatcccaactatatcacatatcaacaggtggagtctgaatccccatccttcatcctgggtaggactttgctattgccaggatgaatagagtggggcagaagtgtagctctgtgactcctgaggctgagtcataaaaggtgattcagcttccacctggctctctcttgcttttgggatgctctcccttagaattcagccaccatgctgtgagcaagtccagatcagcccagcagatagt

SEQ ID NO: 2141 - DNA, 1300 bp, artificial
  synthetic oligo
tgtagataggatttctgactgtttaagagttgatttgcattcccatcattcctacagacaggatctctgacattagaatcataaggtttttgtttaaggatgacttacgatggttttcagaccttgaattcccgcaaccagtttgaagacccccacagaggaacaagatcagcacgagaacagagtttcttcaccttctggtcccatgacttcactctgcactcttccaccaatcaaccgtctccacactttggcccactccaaaacccttaagaattctaacccccaattccacagggagatggatttgagcttcccttccatctcctcattcagcaaccctacaattaagcctctttcgctgttgcaacccggtgtttcagagcactgacttgctgtgtgcatcgggcaatgaacttattatggttacaacagcatctgaagactaaacattttgggggactctctttttaaaaatgaatacaaaattacaaatacaaaacctgctatgaaggtgaacgtttaaatgagaaaagaaatgacaattatgaaatttaaaagctcacaaagacttcaaacttcacaaaatccagaaaaatatctagtgtttttactaattaattgtctgaaacacttttgtgattcctttttctactctggtgggctgtgccgctttgatcgccttttcatgtgataacaattttaaaacattgttttctatagagacaatagaaagatcagtctttcctccagtgtgcttgatctcctttttataaaattattgatagtgttgtaaagtttctttcagattcactagttgtcattggtaattagcttccattgtgatgtattaagagagtgacattttgaagtaactgtgggtctccttctactttacatttttgactactactgagatacttctaccttcctatcctatttgaattttggtatgatgagtaattcttatgtgtgtgtgtgtgtgtgtgtgtgtgtgtgtgaaattagcatgaaattaaggtgcatatattgtgctgcagtgctgcataattgaataataaaataaaaattactcttatgctacatgcattgatgtgttgataagcctgtgtagttttgacactagagcacttgtttcttcaggctgttttgcagcaacattagcaattttgcattccctttttccttctggattcactggactctgtcaggacaagatgcgtcagatatgctaaaatgcgatctgaaacactggatggataaaacttgccacttttcaaacagatgccacttgtgtttg

SEQ ID NO: 2142 - DNA, 1100 bp, artificial
  synthetic oligo
ttttgtgcttaattccctggctagttccaaagggacaggagggccacctggatcccctcgtgccttcagaatcctgactctgaattgcccccatcaggcctggggacctgctcctgctgtggcccgccctctcccacccccagtggtacatccctccaacagccaggccacatccagcccctgacacctgccctgctgatcactccggtactcactgctgcagcggctgctggaagcggtctggagcttggggcctgccatgctcacctccccatctggatattccccagcccttattccggcagctgccttggcagaaggttcatatcaaacctcagctttccaaccccttcagactcctgcccgtcagccataagtgctcccaaaatggcggtgttagctggaagaccagtctccaccatgcggagcatcgcctggggctgagtgagcgccatgaccctgggctcagccagaggactgcaccaaaggcagcatttccaagttgattcagaggagtgagaggaaaggaatagaagtcaaggggcagagcggggctgaggaaggtgggaggaggacaaccagagcaccttcaacaacctcacctcctgcaggagagcagcgtgcactgtgggccaagcgctcaatacttatttgcatcaggcgtcgtcacaacccaaatgatccctgccttttaagggaggaaactgagaaatgacagcttgagtggcttgcccacagtgaggaaatgcagtctgattcccaagtgcaccctctatgtccttggccttcacgtgctaaccaggtcctgctacagatttctcagaccactgaccagatttgccatttgccttgttcctgagtttcaactaacagacaagcacgaatgggtccatccctcctccgccctcagctctgtctccccttagtggcacctgtgctccagccctgtcctccctccctccctccttgcagctcagagcatcatggtcgcagtcagggccagggtcccagcagcctctgtgctgtcatctcttccatccatcatggaggttctcttgcagtgtctgcgttgagaaacaaatgttctcctcctttagtaa

SEQ ID NO: 2143 - DNA, 1650 bp, artificial
  synthetic oligo
atcgcaccactgcactctaaccccgggcgacaagagcaaaactccgtcccaaaaaaataaagaataaaaaagagagagagaagagaaggggagaagacacataggagaaggtcatgtgaaaacggaagccaagattggagtgatgcatctaccaggaacaccaaggatggctgacaatcgccggaagctgagagctgggcgtggaatggattcttcctcagagtctccgaaaggaaccgacactgccaacacctcgatgtcagactcctggactccagaactgtccggcaatacatttctgttgttgtaaagcccccagttggtgacactttgttacagcattcctcagtgggatgatttggagggatgcttaaaatagttcctcagggggtccccaatgggatagagcccccagttgcccacagggacaacgagctcgtttatacaaccttgatgagcttttctcccttccctgtctcgcttccctatggtcctactgggatttcctaagatcacctcaagtaaaccacctgaacccaagttcttgggattttgttttgttttgttttgttttgttttgagacagggtctcgccctgtcacccaggctggagtgcagtggcacagtcttggcttgctgcaacctcaaactcctgggctcaagcgatcctcccacctcagcctcttgagctgctgggactacagttatgcaccaccatgcccagataatttttactttttgtagagatgggcatctccctatgttgcccaggctggtctcaaactcctggactcaagcgattatcccgcctcttccccccaaagtgctgggattacaccgcgcccagtcccaagttattgtctgctttcgggagaacccaaattaagggcccactgctccataccactcatccttcattaacccaaccaatcactatttataaaggaggcagcacagagagtggctgcaatagcccaaataataggcccaaagacatccacatcctaattctcagaacctgtgagtgttattttacatggcaagagagactttgcagatgtaattaagcaaaagattttgagatggagagaccctcctgccttatccacatgggcccaatattattacaaggatccttttaagaggaaggtaggagatcagagtagtgggagatcacatgacctcagaagcagaggttgaagtaatgcagccacgaagcaagaaataccggcatcctctaggagctggaagatgtaaaggatggggccaggcgcagtggcccacgcctgtaatcccagcactttgggaggctgaggcaggcaatcacctgaggtcaggagttaaagaccagcctggccaacatggtgaaaccccgtctctactaaaaatacaaaaaattagccaggcatggtggcgcatgcctgtggtcccagctacttgggaggctgaggcaggaggatcacttgagcccaggagtttgaggctgcagtgacctgtgattgtgccactgcactccggcctgggccacagagcaagaccttgtctttgtaaaaaaaaaaaaaaaaaaaaaaggaaggaaggaagaaaggaagggagagagggagagagggagggagggagggaaagaaggagttgctatagcagtagtac

SEQ ID NO: 2144 - DNA, 1700 bp, artificial
  synthetic oligo
ttatatatttttatatatttgagtgtaggtattcatgtttatgtctccaggctcaataatccccgttctttttgagattgcccatcagtcctgttttccaggcattcaatcagctttgcagctgtaagctgtcacccccagctgctcattgtagctcagcctgcgggctcctggagaccaccagatgcaggtttaacccggagaagttcacaggagggaggttccctagcggctgtaaatcaccctctcccttgcctcctccctgaagctggagaacaagccccagcttgctgtgaaggccataaaacttctcttctttaaaggggccctttgttgagcatgttcactgtagcaggcgtgcaagtccaccaagggcccataaaacttctccaggctttgtgtgggtgaccccacaggcccgcgcatcagcaataccacccttacacccgcagtggaactgttgccgggttcacccagaaactgactggcctcaatttgccttgtgatttgtttgttagctttacaaatggcttttgaggccagacaacccctcctaaccctgaatactgcatcagtgggaattcagggactgcccgggaactgctggaggaaggggaagggggttgggtcaccacggagattttaaaacaattcaccttgggcgttcgctgccctgaatggtgagccaggattgggatacggctgggctgtccttagggtgttttgtctcttgccctcgccagcctctgccagggccctgatccctgagaggcctcagacgcccttgcctgctcctggatgctgaatccactccagcaattctaccagccttgggaaagtgaagtccaagcaaagccaatcagcgggaggttaatattatacttatttcatacatagctcagtggttaacagcacaggcttcaaatcacccaaatgtccatcaacagaatggatataattatgatgggatataacagaataaagtgtggatagaggcagccacatggactagtcacacatacattctactgaaagaaggaagccaggcatgtgagagtcaatactatccacttccatttgtacgaagcttaaaaagaggcaacatttaattcatggtagtaaaagtcacaatggtggttacctctgggtggcaaaagggggatgggtattgactggaaaggagtatgagagaactttctagggggtgttagaaatgttccatatcttgaactgagtgatggtcacctaggtttttttgtatatgaaaagtaattcaggccgggtgcggtggctcatgcctgtaatcccagcactttgggaagccgaggcaggtggatcacttgaaatcaggagttcaagaccagcctggccaacatggtgaaaccctgtcactactaaaaatacaaaaaattagcctggcatggtggcacacgcctgtagtcccagttactctggaggctaaggtgggagaattgtttgaacctgtgaggcagaggttgcagtgagccactgcagtctagcctgggcaacagagcaagactctgtctcaaaaaaaaaaaaaaaaaaagaatgaattagtggattaagaattatgttctaaatagacaactctcaaaagaagatatacaaacagccaagaaacatatgaaaaaaatcacaacatcattaattatcagggaaactcaaattaaaaccacaat

SEQ ID NO: 2145 - DNA, 1200 bp, artificial
  synthetic oligo
aaaattcagtgtcttttaaataaatgttttctaatgggtgaacaaaagaagaagaaaaagaagggcattactagaaatagaaacgaggaggagggaaggagtccatttagaattattatattcttcattaagagataaaaatcttgtcttgccttgttctctttgttggagaagagccccctcacctctggaaggggcaaggagtaaacctgccatccatagctgctcaaaataaacaatgaaatcagagtaagacaccagggcaaatagcaggggcatgagcatggtagctctggttccagtgcctccaagtctcacggagtgttgtgatgagcatggagactatatgcacagtgagttgtgccatagctaatggaacccagggctgagggctccatgcgttaattcttaccagtcagattgaagcaaagttgccttggtgcacatatgaggaaggagctgaggtgtcatgcacagccaaatagtcatgttattgtgagggtgtcaggtatggctaaacagtgctgctattgtgagagtgtcatgcacagtgaaatagttcagatcctgccatacctacatgagtgttctgtttttatagcatgaggatggggatggtaaacccagcagcagcgttgtgttgccaattgcagctgccgcctgactcaggtggaccatgtgattgttttgccatgctgcagtgctacatctaggggacaaagaaagcattaaatgtttccccccttcccacacctcctggagactaaggtattccttccccaggtcccaggtttattgctctttccatatagtccatttgttttaaatcagtagccactatttctcctttcgcccagccatccaccacctctacccagatggacgaaggctcatgggaactgggcaccatgggtagaacttgcaacagcctgtgatgtcctctaacattgcccaagcaggccactgtagggatactctagtgcccatgaatttcaccaactattatcctcatggccagcactcttccatatccaacacctgaaaccaagtcatagcagaagcaaaaggttgcagtcaccttcctcctgttgcctaaccttaggctgaaaccagtcaggcttaccaggcactaagggccagtggaaaaaaagaataggggtggctgaagattgtcaggatgcaatcatagatacatagcac

SEQ ID NO: 2146 - DNA, 1150 bp, artificial
  synthetic oligo
atctcctgaccttgtgatccgcccgtctcagcctcccaaagtgccaggattacagcctgagccaccacgcccggccccttcttcattcttttgagatgctccctgatgtatttgagacctttgctgagtgtttaagactcttcctgttgactttgagatacatcctgacaaatgtaagacccttccctactcactcaagactcttcctgatatatttgaaaacttttctgacttgcttgaaactcttcctgagctatctgagagccttctgacatgtctgagaccattcttgagggatctgagagtcttcctgaccctaagacccttactgaagtctttaaaattcttcctagctacattcatacactgcagaaagcaaccaatttgaggctgaagtgaagttagagaggttacactcctatgcaaatatctgattggttgcagaaagcaaccaatcagaggctaaagtgaaattacaaagttgcactcctatgcaaacaaagacttggcccacaatcagtctgattggttgcggaaagcaaccaattagaggtactttcaattttccatctgccatgcagaaaagtggggctttgcaaagggagtagcctctggtctttttgttacttaggtgtggaaagttggggttttcctttcaatttagctctaggaagtcaccataaatcggccttaggttccctgcctccagaccctattctcctgcctcatgagaccttttctggcttttctgagccccttcccgactttcttgagacccttcctgacatgtttgagactctcagatgtattcgagacctctccatctttttgagacaccatacagaattatttacacctcagacttactactttgagaaactccctgacttgtttgagatgtttcctgatgtgtttgagaactttcctctatgttctagacagttcctgagaagtttaagacactttctctcatgtcactcactgtcaaatactcattttgactttttttttttttaacagagtctcactctgttccccaggctagagtgcagtggtgtgatctcggctcactgcaacctccgcctcctgggttcaagtgattctcttgcctcagcctcccaagtagctgcgattacaggcatgcaccagc

SEQ ID NO: 2147 - DNA, 1500 bp, artificial
  synthetic oligo
aactccatctctactaaaaatacaaaaattacctgggcgtagtggtgtacccctgtaattccagctactcaggaggctgaggaacgagaattgcttgaaccgggagatggaagttgcagtgagctaagattgagactggactgcgccactgcactctagcctaggtgacagcgtgcgattccgtctccaaaaaaaaaaaaaagcacagttaccagtagattgtggagaagtctgaccaagcagctccactgctacccttttgctccttgctggcctgaaattttctccatcggaatcacctccctgggttgtgtgaccgtgcctgtagctcacctattcccacagcttcggtcactgttgattcacatacaggctcagcctgacctcagccctaaggccaaacaagacccactgggtaagaaggttataggagacccctagcaccatgcagggattcagcatcaagttggcccaactgccgtttgaggatcggcaagggaatgcccagtgttcctgacatgtggtcaccctgcgttgtgccaggtgtaagaaccgcacgcagtgtgggtaatttccctctgtaggactgcattctgccagacttttgtccgtaattgtcccagagattgcagtctttgcagctgctagcaaacattccctaaatagactccttgcttagctgtctgcctgcctcaggctctgaatgttgccttcccctggagccttggtcaccaagttctgccctcttggtgagaaaccccattgctccatccccatgtttcagccttccgtgctgaccatttcatttgttgttcactgccaaactcttcagtaccgttgctattattacctccatattgtgtcgtatctgctggaatgaattttgtctttgtgcctataactagggtgcaaggtccaaagtacaacccagcccttcccaggctgtcccatcccattgcccgaaataagacatgctggacactgggagcaagtccactgttaaaaatgtgcatcccgttcgtgaccagcctgggcaacatggcgaaaccccatatctacaaaaaatgccaaaaaaaattagccaggtgtgatggtgtgcacctgtagtctcagttacttgggaggctgatgtgggaggatcatttaagcccaggaggcggaggttgtagtgagctgagatcacgccactatactccagcctgagcaactgagccagaccctgtatttaaaacaaaaacaaaaacaaaaacaaaaacaaaaacaaaaacaaaaaaaactgcacatcccttactggggggttttctgtgactcctctaaaatttagtctgcttaacattttctttgaatatctataatctattggctactcattgacatcatacactcttttttcccccccgagacagtttccctcttgtcacccaggagagaggggtttcaccacgttggccaggctggtctcgaactcctgacctcaggtgatctgcccacctcggcctc

SEQ ID NO: 2148 - DNA, 1150 bp, artificial
  synthetic oligo
ggccccccaggataggtgcttggggtgcagcagctggccaaggcgctgtgccttgttgtctaggtggtgtgcccacccgggctcccggtcccgcctggtcacaagcatccccgcgtcagctgatgaacacccctgtccagcaggtgccagacacccgaaatcaagaggagtgtcctgtgctccaggagcctgagaggtggcaaagtccccggggggaggcgtgatggtagggaaggcttctgacatacctctgcaggggccagggccctgagtcccgggtccccatggtgtgtttctgtgtgaagtcagtggcactgccagcgccgtggtcatattacctaggccacagctgccaggcctgcaagctctttcctacttcccttaggtgcccagacccaaagtcaagaggaccttgacccgtgggggtcgtggggaatgaaaaccgtcctgcgaacttgaacttcactagggaggcggcgctctctctgccccggttctatcacgcgcatccgttaggaactaagcggcacctgcgcgaggctaggcttgttgacatatttcttgctggcggcgtcctctcgcgtggagcacgactgcgcaaagcgccgacagtcccccgagcgaggacggcagcgagactccgaagcccccttagcaaccaagccggtgccgctgcccttgcgccgggactgcagccgggtcttccgaagtgaggatatgctgccctctagaggccgcggggtgacatggcccatgaggctgtctgggcagggtgggttcgggtgggaggaaccaaggtggacaagcctcgaagtaagagatctgttcaaggtcacagggagtcgggactcatgcggaggcacagatccaagctctctgtactgggccctttggtattctgttggctcctatttttttgtttgtttgttttttgttttttgttttagatggaatctctgtagcccaggctggagggcagtggcgcgatctcggctcaccacaacctccactgctgggatcaagcgattctcctgcctcagcctcccgagtagcggggattacaggcgtgcgccaccatgctggctaaattttgtatttcttagctttttttaagctttttttttttttttttttgagatggggtttcgct

SEQ ID NO: 2149 - DNA, 1050 bp, artificial
  synthetic oligo
tggggtcagggaacggggcagggtctggggaaggtttaaggagagaaaggggccaggcagatggagagaggacaggagggccagggtggtcaaggcccggggataaagccgattggtatgtcagcaaaatctgtcactggctttagtgattcgaaaggcagacacattctttcatctctgttaatcctcatgtgatacagaggattttcctgccattaaatctggagaaagaaaaataagcactcaaacctgcacaagtaactattcctcttcaccccttcctcccgtccccccacccccacctttacttctctctcaaaccattttcagcatctgtggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatggtgagttctcctgccggtgggtgcaagggttgggaagaggggtggaagccacagagcttctgcccaaagagtctttaaagtggcttctgggacagcggtatctggacacttctgatcaggtttcactgaccctgtgatcgtgggggaggggatagagaaagcaagaaaacagcaggtggtggggatttttgtttcctaaaaacaaaactcctgagccgaat

SEQ ID NO: 2150 - DNA, 1400 bp, artificial
  synthetic oligo
ccatggcgtctcagagggcaaagcccagagtggcgtaggagaagagctgttgcttcagagaagggttcctggcataaccaatgatgaggctcccaaacacagtcccaatctgagccgcagagccagccaccccaactgcggcagccccagctccagtgaacttggctgttgtgtcgatgtcccttgaaatggtgctggtttggaagctgcggctagagacaagtgaggtaaggggacgtgagactgccaagctgctgaggctctcatctgtcagtatctccggtcatttcagcaccactgcagatagctgacggctcagcagctgtgaggtgctcttgaccaatgagggagaggagacgagcttggagcaggcgaacgttttccggggctgaggggctgtagcaggagagctgctcccactgcagagaagacagtaccagaatttttttaaaagaagaagctaaaggcaatttcctctttccaatatttacactggcaccataggatgccagcaaagggctgctggaaactgttcctcttctaggttaaaagacatatacacgaaatgtacaggtctagagcttgttagagtaaggaggtgctcagtgtccagcctcctcctcctcctttctccttcttctccggggaagagtaggagaggcaacactttctttcctattcctatttagctggatttcaaacctaagagtataaagacagagtgggtaaatacccagaacctggttcaggaacgtcttggttcagtacacccctctattctgacccaatttttgcactggtggattggggtacaatgacaagaagggtaacgttatggttagaccaatgttaagtttagggagaaggtggatgtaacttgaggagaggcagacgtggttagaaatggcagacacaagcagtatatctgagtatcaatttttctttggcagcgaaagcataaggaatacacaggttattttatgtacatataagctcgataaatctggcatttctagctctcaccaaaaggtccatccagtgtcagctatatgatttgtggggcccagtgcaaaatgaaaaggcaaggtcctttgttcaaaaagcagtgaaaaaatgctgtttaaaaaagcagtgaaaaaagctttaaaatataaagcttttccctttcgtccatggtctctctctttggactttcatggtgttttctatctgtgatttaatgtagttctaagtgaagaaaaattaaaatcttaaattattagaatgaattttaccattcatttttgtactgtgcaatgacagttttaaatgcaaatataagagtatttaagtcatatgtggaataatcaaatacgcgatttgtcttttgtagtttgtatgtgtgtatgtgtttcattctt

SEQ ID NO: 2151 - DNA, 1150 bp, artificial
  synthetic oligo
tgtgacaaacagaagcataaaaggcagtaacaaccgttttatgtctcagaatccctactaattcccaattattgcattttcatcctgagacggcctttgaacaactcttttttcctccctctgtgtacatcctgagattataatgcattaaacatcattcatgtgatggcataatgctttttttcttcccccaacacatactctcaaatctcttttggtagacacatttctaagaaagctgagacaaagacagagatgccactttgatattagggtccaatgcttggagttttatttacatgaggaatgaggcagcaggtttaagggtatcaatgtttaatcacttagataggacaagagaaacagaatataggggtggagtagacctaagagaaattatcaagttagaattgaggtgacctgaacccttgaatagtcttttccatggggaattgctcttttccctaatttcaaggagagcagtgctctctcttaagcaggcttgacctgaatttccaggtgttttagttatctatttctgctgaacaaaagattcccaaacatagtagcttaaaacaacaaccatgttgttatatttcatgattttgtggatatgaaatttgggtacagcttgtctacatgattcttctgttccttgcagtgtcaacgtaggtcacttgctagtattcatctggtggatgaacaggcctgataggtctgagatggcttcattcacatgttgtcttagtctgttcaggctactataacaaaataccattaactgggtggcttagaaactacagaaatgtattgctcttagttcttgagcctgggaagtccaagatcaaggtgctggcagatttggtgtctggtgaggcctaactctattgtttactgatggcaccttctctctgtgtcctcacatggtggaaggggctagctgttttttctggggtctcctttataacggcaccaatcccactcatgcaggcagatccttcatggcctaataacctcccagaggccctactttctaatactatcacattgggtattaggtttccatgcatcaattttggggaggacacaaatattcagaccgtaacacatgtccagcaccttgatcaaatggctggaagactgggctcac

SEQ ID NO: 2152 - DNA, 1000 bp, artificial
  synthetic oligo
tgtttgcaaatgagtttcaaaaatcataaggaaaactttcctcctttctggaaaattcccacttcaaagctaaaatgaaagcatttaaaaaaattaattttcaacaacaaaacagcgttaatggatatacctaagggcaattcagtggcgagagaaggcatatatgttttatgtactaacccagctttgccaagtttcccactttgctgcaaagttcattttcaaaacattggtaatctatcatttgacagcttgttgcttctgaaattctaaatttctggtatgcagctaatgtatgtacatttaaaaaacactagatctgaattcatatgtatgcaactcttaaattacatgctgctgtcaggtattgacttttatggttgatagctttaatattactatttgtgtctctataaattattttatctgaagccaaaaaagatgaaaatctgggttttattaatagatgtactaagcataacactcaagacataattgatatgaatatcaatagcatgattttaataacatcaaacattttggtgtcatagggaaatgtcttctaaatgcagagtgtgaaaggtgcagtgaatcaggggcaggctcgtaggaggaaatacctgacttgaatctatgaaaagaatggaagagtctgaaaaccattagagacagcatttgaaatagtccagaagattcacatttatcataaccttgatttttacaaccataaaaattacaaattttatgaaccaaaaacaaaaaattggctgcaatgaggccatcaagatttctagaactatgcaaacaatggggatttgttattctccttaaatgttgtatggaaaatatttgtgtgtgtgtgtgtgtgtgtgtgtgtgtgtgtgtgtgtcttaagggaaaatgaggtgtttaattacagagagagactcctttagagtatttcctaatgacaggaatttataactttagggatgtttggtttctttccaagtttggacct

SEQ ID NO: 2153 - DNA, 1100 bp, artificial
  synthetic oligo
acactgggtcagacctgaagccagcacagcactgggtcttaccaaagttctgctgtaaccactctctggctactgcctatgtttgctcaaagccctggggttgtacattcagcaggtggcaagccagttaggcctgtgttcttccctttagggtggcaagttctcccaggccccaggcatgtccagaggtgccatctgggagctagggactacagtcaaaaaccttagaagtctacttagtgttctattatactgtgactgagctcacactcaaaccacaagatgcagtcccttcccactcttccctccccttttcaaaggcagaggagcctcaccccatggccaccatcaccagaagcccatatagagtaataccaagctagcactgatgttcctttaaggcccaaggactcttcaagtcagcttgtggtgaatcctgcctggcctgggactcacccttcagggtgatgggtgcttctctgacctgagggaggtccagaaatgctttctaagagctaaatcctgaaattgggaaccccaagagcccacttggtgctctaccctgccgtgaccaagctgatacctgagatgcaagagaaagtcccttttacttttccctctgcttttttgaagtggaaggaatcttgtccaataggtaccaccagctgggaatgtgctgagtctcacctgaagccagcaagtctcagagtctcatccaaggcccttgacatagtacctggatatcgctgctggttattcagggcccaagggctcttcagttagcaggtgatgaattctttcaggactgggtctttcctttcaaagcatcaggttcccttgcccagggtgtgtctagaactgtcaagggagcgagggcctggaatgggggcctcacaactctgactggtgccctgtcctcctatggctgagctgatatccaagatgatagccttccccactcttccctctcccctgctttcctctcctattcccccctctcctctcctctcctctcctgtcctcaaatagagggaaagggttgcttttggagccacaagctgtacattctggggttagggatagggtgatgccagcactcc

SEQ ID NO: 2154 - DNA, 1650 bp, artificial
  synthetic oligo
cacccatccccaatagagacagcatatggtcctttccacagggtgctcaggagagcagagaaaggataaactactgtctttttccgggattcttctacccaggctggaaagatctagccgtgttagctgtgcaaatgacgtgtacccaggatctggtgaaaaaggccaaaggggaatcccttaatcataaatggaaagaaaacccactgatgagtgagaatcatttcaagtaaatctagaaaccagtagctgttttaaataattctttataacaggaaagttattgcccactttacccattggcaatgcccatttcagttccaaaatctaactagagatggcatatggactgagaattagagtatgggacaatgtctcattcacctttgcatccatcgggactagcatagcactgggcatctagaaaatgcttaataaatatttatttaaaaattgatgaaataaataattaaccagagaataatagtacttgaattgtgagttcttaaaataaagattgctggccaccattggtggctataattccaagaaactcaccacatttttcaagggcccaggaaaataaatgagttggaaattgttaaatgtattgaaaaatgatttatttttcccttgacagtgtcattggaactcgaattaagattgaaaactccacaggcacatttccatctgtgggtgtcagctgcttggtacacagtcgtaagaaggcctcagccagttctcccgttacctgaaccaaatgtattttaaaataaatgatgcaaaacattgcattttgtgttcaaatactctcatgtaatgatctgaataatagtctaagaaaattgttttgattcagctaaatgctttgctaaccgcagtttttttaaaaaaaaattacaataaaattttacagcaatggaatccatagtgtcttttatggctttcttgactaatgaataccccaaagttgtaaattaacctattcaaatatcagattttcattcagcgatgcttattgggctggttatcagagaaaatcagaaaagttttgcataaactgtgtaccaatttgcaatgaaaactggcaaacaggaccataaagtttccttgaattagtaagactgatgagaagaaaatgagcagatatttgcatctggtttaaacgctcagttgagaagcattgtgccgtccccgctgtatttggttgacacccacagcaactccccatttcagtcatctctctgttttcaaatgcacctggtatttaatcttatgtgttggggtaatttgccaatgccagctccttgtaattaaaatacactaatattagaaatgaaaagagacatgtttcacagcagccatatctgttattaatgagttacaaagaactgtacaagggactcccatcttgccaaatagcttcctttcccgcacctgaatctcagtaaagatgggagtctgcctctcatggaggcttatctgggtttgtctattacaatgagcctcagttactgggcgttctgagtcattaacattctgtacacaatcaaacttcccgtcccccaagaaagagttatgcccaggcctcctacagctcaattgttcatttaaagagagaacttgtattccaaagtttgaaagaaacct

SEQ ID NO: 2155 - DNA, 1500 bp, artificial
  synthetic oligo
cagagaaaatgcatttatttgctaggttagcaagtgccaacatcagtaattgaatttgtaccaaaacatgcatttttaaaaatgttgttctgttccattcattatttatagaatatcacctaagggcagcgcatgctacaagccaaaaatctcatcctgcattttatcagaaacccattgcagggaaggggagaagggagagggagggagaaaataaaatgagatttctggaaaaagctaaaggaacttgtctggcatgttttgtctggaccagcaatgcccacagggcaactcgataataatctccaaatgcaaggggactggagagcagctgctctcaccactcaggacgggagaagaaacctccacagcaccatgaaagatttaggctagttagaaagggaaacttctttaacagggaaggtaaagcagtggaattgagagcaggggaagacttttagatgagggaagggtctcgtgtattccagacagtgtcaggaaaagaagtcgattcgatgtttccttgactctgagacaatagacgtccctagaggtcagcaacgcaccagggaattttccagagcctataaagggtggttctccgggaagggtggcatgtgatcacgttaggagcatgggttctggtgcgagagaccatgctttgaatgtcatgtttgggcaaatgacttaaactttctgtgcctgcttaagtattcataatatggggataattgctcattcaaccctacggctgtaccaggcattgtcctgggaaaagggaatacagcaatgaacacagtaggcaaaataaaaaacagaaaaagaaaaacagcaacaacaaaaaaccctgacaattataatgggagtggtagacttactgtaataacaaagaataaataaggaaaatatactgtatgtctgatggtaataagtgctatagggataaattaagcagggaaggggggtggggaagttctaattttaagtagggtgtggggggcaggtcacacgctgagaccacgtcttttgaggaaagacttgaaggaactgaagaagtgagctaagaggttgtagtgggttgaatagcccttctaaaaggatatgtccacatcctgaccctgggaacctgtgagtgtgactttatttggaaaaaagggtctttgtagatgtcattaagttaaagatctctggatgagattggtctgggttatctgggtgggccctaaatccaatggcaggtgtccttataagagacagaagaggagaagacagacacagaggagaagaccatgtgaagatggaggcagagattggagtgatgtggccgcaagccaaggaatgcctgaagctaccagaagctgggagaggcaagaaaggattctctcctaaagccttcagagggatcatggccctgtgacacctagatttcagacttctggcctccagaacagtgagagaataaatttctcttgttgtaagtcaccaagcttgtggtgattt

SEQ ID NO: 2156 - DNA, 1150 bp, artificial
  synthetic oligo
cttgcttttccaattcttgtcgccaacagttttttgctatgtggttcaaacacacagcaaagtacagaaagtaatatgacgcccgtgtgctcactgagatgttacacaagtcgatattttcctatgttgcatagacatcagcttttattttgtaattaaaacgttcaagatgaatctaaagccacatataccctgacgaaaacgcgttgtaatggtaaccaccgccttcagtttttcttctggatatttttatatttgttgtttgtttgtttgtttgttgttttaagacaaggtctcactatgttgcccaggccgatctcgaactcctgggctcaagcagccctcccgcctctgcctcccaaagtgctgggattacaggtatgagccaccgtgtccggcccatttttgtatttgaactaaacgtttgtaaggcccaatcaggggtggccggggcggagtcaggtgtcacaaatcgcaacccctgtcactccatcgttcaccccaagatagccgggccaggaacctcctctcccgacacctacgtctaatccctccctgaagccctaaaggttggactcgatgctctctctcagtcaccacctcgtctatttcagctgcgatcccattgtttcttgcctggttttcttctttaaaaagaaaaacaaacacacacaaaaaactaactgatcttgcctccagagccgtcgtttttataattcatggtgcagctgttactcttctgcttcaataatctagccttcccgccgccttcagaaggtggtgaaactccttatagcctggtctgaggagcttttgtcagagggcacctaccaatgccctccatccctttctttgccccctcctccatctactccagctctgagaaaccactggcagtttctaaatcaggctctgcggtttctcctcttggggcttttgcaaataacactatcgtctagaaacacccttccttcctatctttcacataagtaaccccttcttgtctttcaggacttgaggccagcgtgggagtggggcatagaaggtattgccatttcttcaatatattctttcaccttcttcctgccgcctccatctgtatttggtgtctattctgatcgtggctttcatcctactacattgtaattac

SEQ ID NO: 2157 - DNA, 1100 bp, artificial
  synthetic oligo
ttcttcttcctggccccctcttcccatgcacatccttcccatactcccaatatcaatatatcattatttggttaaatcagtattttgtgtttaaataactacggttatgtcaacaccatccaaagctgggccatgaggtctacaaggcccactttttctttcctgcatatatttttgtttctcagaagttcttaattgtgttgttagtgccttacttggttttctatgtatttatcatgagttcaaatccaaattcttcactagttgtctaaatcttctctcaaaaaagtcagacataggtcaggcatagttcatgcctataatcacagctctttggaaggctgatgtgggaggattgcttggggccagcctgggcaacagagcaagaccgcatctctacgaaaaattaaaaaattagttgggcctgatggtgtgtacctgtggtcccagctactcaggaggctgaggcgggaggatcctttgagcctaagagtttgaggttacagtgagctatgatcacaccactgtactttagcatgggaggtagagctagactagaccctgtctctatagcaaacaaagaaacaaataaacaaagccttcagatatattgggtttttaacggtttcatctttctgaaggaatggctcttgaagccttctgacctgctcccctgtggatggggtggtcccatgcctggtacacagctgtctcctaggatcccattcccctctctcctgtgttggagcccttgtttcctacaactcaggtctcctttatcttggtctactgcacactttttaaaaaaatttttttttattttgagacagagtttcactcttgttgcctatgctggggtctaatggcgtgatctcggctcactgcaacctccccatcccaagttcaagtgattgccttgcctcagcctcctgagtaggtgggattacaggcatgaaccaccacgcccagctaattttgtatttttcgtagagatggggttttctccatgttggtcaggttggtgtcgaactcccaacctcaagtgatccgcctgcctcggcctcccaaagtgttgggattacaggcatgagtcaccgcac

SEQ ID NO: 2158 - DNA, 1350 bp, artificial
  synthetic oligo
aagtgatcctcctgcctcagcctcccaaagtgttgggattacaggcataagccactgtgcccggtctcaattttattttattgaaccatatgaaattgccactcctgtttttacaaaatggtcgaatatcagcaaactcatatggctcaacctaattaaatacgtattttcctgatttgcacaaattatcaattcaaacacaaagttgtgaagcaatgtcttatttaaaaattaagcattaaacatgcgaattgagaagattaaatgactgatttcactacgggtggactagactgggacacaatattttgtcttccatcataagaaaaactggccagtatggtgaaaccccgtctctactaaaaaatacaaaaaattagccaggcgtggtggcgcgtgcctgtaatcccagctactcaggaggcggaggcaagagaatcgcttgaacccgggaggcggaggttgcagtaagccgagatcgcgccactgcactccagcctgggtgacacagcgagactccatctcaaaaaaaaaaaaaaaaaggaaagaaagaaaaaaagaaaagcccacgttattgaaagcattttttagaaattgggttgccaaaaataagctagcactgaagcacagagacattaagagaaactcaaacttttcccgagaggtctttctgtatttcagcactacaggtgtgggcagacagaacagctcatccagaaagaatccaaactgaaaacctaactttcaaatcacacccacatgttaagctggtgcagcagcctccccagatacaaggaaaatgacccttctctgcatggcactcagtggtgtaaagacactcggactcttaagcttatagaagacagagctttctagtgggctgaaaatacttaatgttccattgtttgccctctgattcctcaggtggccactgaaatctcatgcattcgtcggctcaaagtttggaattctacctagtcttgagactactatcttgtatttctttgcagtaatttttttgcattgagatttctttccctctgaattctagcctggtgccttgtaggtttcttgctgccttccctttcccagataatagcatcctacaaaatttggtgttatttctaaacccagagtagatacttcagtcctagtgattatttccctaggctgtcagctcatatggtagccctcaaaagttgaatgctggccaggtgcagtggctcacacctgtaatcccagcactttgggaggccaagggaggtggatcacgaggtcaggagtttgacaccagcctgggcaacatggtgaaaccccatctctaccaaaaatacaaaaaattagctgggc

SEQ ID NO: 2159 - DNA, 1150 bp, artificial
  synthetic oligo
ccccatctttcctctggttctgacctatttttctgtgtccttgttactgtggtcatacccagagaagtaacattttgtcttgaatttgtaaaaatctctacctttccccacaaagggatttcagcacagtggctattttaacagataccgtgcagcacgtaccacacgttcccttcctgagtccttgaaagtaattttcagcttttgatcggctatattgttcttcccagctacattttgggaagtccagcagaataacttgctactcttttaaaggtcctaatgataaaacgaaacaaaacatcccctttttatcatcacccacaaagccctaatgcgtgcaacaaagattgtgaaacgtccagggaacagtttgtgagacagaaaggatggctttgttgattagcaaaaagctggaacgtggacaccggcaacacaacaggattgggacccgccttcttcaagtgaaacaaagttggaattattttcaattttaatgttaaatggtttttttgtttgtttccaaattatttgaaaagttactaatccaagcgtggtatgagtggtatcattttggtaattagattaatgcactaccagatcctagaatttcccactttaccaaataaaagaatgttctgtggaattctcctagaccaagacaggcttttcccctgagcaatagtgataaagttgtctaaatacatgaactggtggcatttttcaaaaagtaataatgttataatcaagaggtggtgttgctatgttgcccaggctggtcttgaactcccagtctcaagtgatctgccagccttggcctcccaaagtgctgggattacaggcatgagccaccgtgcctgatggtggcattttgtcttcttcacagaaaaagttaaaagatgagttggatgacattgtgaattgtgaacaacatagtgagatcccgtcccttaaaaaaaaaaaacaaaaattagccacgtgtggtggtgtacccctgtagtcccagctactcaggaggctgagatgggaggatcatctgagtctgggaggccaaggctacagagagctgagattgcattgctgcgctcaagcctgggtgacagagtgagaccctgtctcaaaaacaaaacaaaacactgcctattttatt

SEQ ID NO: 2160 - DNA, 1250 bp, artificial
  synthetic oligo
tgactcatgctatgattttgtttttgaaccaagaatttatttggttcttttggtattcccttagctttttagcccttctttttagtttttcagcagcatttcttactaggcctgattggttgagatagaaacaacatttcttacccaatgagaggcagaggccccctttttcaaccattataagatttagtccccatctgttttggaggactactccagccaaggagtctagttggtcatggactcttataaagcttcgggctatatcttctaaagagccctgtagttttgttgaaagagccttaaagtatgttaaggaggtggctaatccgcttgctcccaatcaaagtccagaggttatacctaaggcggccgttaaaggaatgacatggatggcccatctttttctaacatattggacggatgggatgggcaaaggctgattaggaggaactagtctgatggagggaaatagataaactagggtacaggttccggtccagttggtggggagacaaagataggtgttgctgccacacaaaaagaacaagactttgctgtaaacacaggcagaaatatggaaagagaacaagtgaattaaagatggggtgttttttgttggtttgtttttttgtttttttttcctgtggttcattactccagactgacaaagaggaggccagggaggcgcctactgtagtagagatataggaagagttactttttacacatttaatgcggtcggatgttgcgccattaatattgagccatggaaaaaggtgggcattagggaaagcacaggttaggcctggaggcattggttaagggagaggccgtaaaacgagccggttgcagaaatgttcccatttgcttcaagtgacacttggtagttaatttgattagtttggtagtcagaggggtgtttaacaacgatagcggataggcggttgcattggttaagtgttaatgaccctacagggatatttcccttagaggccgaaaagtaaagtgaggcttgttgaaaaaggggagtgtgtttagttataggcccttcaatgggagggccttggggcttaaggcgttgtagggagttgtaataggtttgaaataatttgttagcctgattggccctggaagtgggataatcaccgattagagtgtcaacttttttaaaaagggaaactcctttttggagtttataaattagggttatatttccagttaaaaggtcatgaaggggtgcaggaagg

SEQ ID NO: 2161 - DNA, 1500 bp, artificial
  synthetic oligo
cagcaatttgggaggccaaggcgggcagatctcttgaggccaggagttcgagaccagcctggccaacatggtgaaacctcgtctctactaaaaatacaaaaaaaattaatggggagtggtggcatggacctgtaatcccagatactcaggaggttgaggcgggagaatcgcttgaacctgggaggcagaggttgcagtgatctcagctcacgccactgcactgtactctagcctgggagaccccgtttcaaaaaaaaaaaaaaaaaagaacagacaaaatgaatctacggtgcaacaagtgagggtaggagcaaatgcttgggaaggacacaaagggaggttccgggggtgctggtgatgttctgttccttgacctaagcattgtcactgtggggaatgtgtattcactttggaataattcggtcagttggacccatgggttgtgtatatatttttttcctggcaggtgagtggttacacactccactccttagtggattttggcttccatggctactgtcctgctgctttgtacatttttctgataaaagcttcagtgaaaggttttacaaatcaacagaaagaataaacgatgaagaggaaaatggcctgggaaaaaatgatttcatacagataagcttcccagacgctcttgtttcctgactcccgtccaagcgcggtggccagccatctaggcagccttccttaggctttctctcggcttctgcctttgtctgcagccctcctttcttttcactccaggggctgtttattgatctccttgctgccatgccttctgttcccatggtaacgcaggggctgccccatgctgttatgcacttttctctcctaggctcaaaacaagcattgcagaaacggttctttggaacgtgagtccccctagatactctatggaaagagaaaccggttcatggtcaaaacagttttcagggggcagatatggtggctcatgcctgtaatcccaacactttgggaagtcgaggtgggaggatcgcttgaggctagcagttcaagaccagcctgcgcaacaaagtgagacaccccgcccccactacacacacaatctctaaaaataagtaatgaatgcccttactcttggaatttcccagtagatattagcatcttaaaggctctgcacctgtttaaccaaaattttccctaacttttttgaccctggagagccctcccaccgctttccctttaacatttgctggtgccctgggggactatcttttgtggcaaccattttgggaaatgctgcccttagcccttttatataactatttgatggacagctctatctggatgtcacaaagatacatcaaactcatcttgttcaaaacagatttgatactgtccctgtaatcttcagttcctacatcttatcagtcctccaaccctaggatttactttcttcaaatgtctctcaaccccctgacacatctcatgcttactgcttttttttttttttcaatgggg

SEQ ID NO: 2162 - DNA, 1100 bp, artificial
  synthetic oligo
tatataggctgtctgcaagctgaggaacaaggaaagccagtctcaatcccaaaactgaagaacttagagtccgatgttcaagggaaggaagcatccagcacaggagaaagatggaggctaggaggctaggcccatgttgttcttttctcatttttctgcccgcttcatattcgatggaagctgattagattgtgcccaccagattaagggtggatctgccttttccagcccactgactcaaatgttaatctgttttgggcaacacccacacagacacacccaggattaatattttgtatccctcaatccaatcaagttgacaactcagtattaaccatcacagggggtctcactatgttggccaggctgccctccaacccctgggttcaagcaatcctgctgccttggcctcccagagtgctgggattacaggtgtgagccactgtgccccacctggaatttgttttaactggctaaatccaggacccctggagggtataagtgaggttaaatctgcagggtggtctcacctggctgcatggggtcctactgataattttgctgtgaagatgccaggaccaaggggtggactaagcagaagggggttaacatagcagtcctgtaactattgtcctttgaaagtcctgcttacaagcttggcccttggctggcaattaggaacttggatttcgggagtattcccagaattccttaactgataaggatggcttactcttcccaacctgtttgtgcaaacagtggtttctgctgatcaccggctttcattctgggagcctggaattttggtaagcactaggtagagggtgcctagtgaccagcccccagtgaaacctttgggcaccaaacctctaatgggcttccctggggagaagcattatacatgtgttcctggatttttgttgctagaaggacagctctgtgcaagcctcctgcgagggggagacagcatgaggaggcctgtgtacagcatccttcacattctgcctgtgtctttttaccttgacgattctgtcacatatccttttgctgtcataaaccttagctgtgaggacaattatatgctatgctcagtgctatga

SEQ ID NO: 2163 - DNA, 1800 bp, artificial
  synthetic oligo
aattattcccctcccgccaaacacaaccagaacagttctaatcaggccctcttctccccacaaaaatagggaagtagctgggctgaagactttaagtgtgacatttcagttcctaaaacatcactgctatttgctcaaagttgtaggtctatgtatttccttctccaatacgtccccatttataagtttatttccatgcatacaaacgtgcacatgtgtgcacgtgcacacccacacacacacactcactctcaagtaagacacttttttgtgtttgttgataaattatgaggattatgaaccaggtgtgtacagggtttcataggtgctttgtaaacatcagagtcacttgggtcctttcctccacaagcctcaaatcaaattacgcaaccaatgaccactactttcccagacgctgttcacaggctgcatattgacgaagggcagagaaaaagtcctcataactgatgtttaggtgggaaggcaaagagacaatctcagtcaatctgatgtgccagggaagaaagcctaatgtgctgtccacaggaccgaacttcaatactaaatcaggatcaggacaaccatttgaactaagtaaactgcctaacgtatctacatccaaatctgtgggtctcttttgcttctgggccactaactggcaaaagtcctgagcagctcttacaatatctgcttttccatcttccggagacagcaccttcactgccaaatggcaatttaaaacttgatcgtctttgtcattactatttgcaaattctggtgagtattttgaacaatctaggcccagaagttcttgctgttgttttaaaatttcatccatcaatctggaattatttcttttgaaaataccttggtggtcgtagacgctaatgtaggagatgcccacggccatacaccacaccacgaggctcgcgatgtccgagaagctgggttcctgctccacctcggtgatcaccaggcccatatgcacaggcagcttctccaaggaacgaccgtccgcgcgccagcgcatccggtggtgtgcggctgccaggcacgaccccccgcgcgggtgccggtggtgacggcggttcctgccgactgccgggggcttgcggagcgtgaagccgagcggcgctaggaccgcggcagaggcggctcggcagcagcgccgccagatccagttccaggtgccgaaccgaacgcggagccaggaggtgagcgtgcggtgcagacagagcagcgcgtgcagcacccgccacaccagctcgtacagccccgtcatactcttgtggccctcggacaacccctctccctcccgcccactcccgcagcgcgacggctttttatccgcccctgcggccgcgcgggccatcgctccgcgtccccccgccccccgagcccgaacccctttccactgccaacatctcacctcgcccccgccgccatcttcccatgccttctattttatacaagcaaaaagaatagaagaaagcagcttacctgccaccagccccaaacctcactttaaaatcaagtcagtccacatggccaaggatgcttgtcttttcacagacatcctcgaaatgaaacatctgctgcctgctaacagcatgatgaagactccaaactttcccatcaaccacacgctctcctggaatacatcactccaccgttatcttcctctatattccagaactgaattctcatgacctttaacctccagtcacttccccaaattggaatgtgtagggcagcagtgaactgcataaccggacctaacatgcttacgaaaacgtctcc

SEQ ID NO: 2164 - DNA, 1550 bp, artificial
  synthetic oligo
atttagtaaatttactaaatttatttagtaaattaagtcaatagtaaaactattaagtaaaagtgtttacttaagtaagtgttacttaaatagactaaaagccctttgggggtatgaattaaagttggtagagggaatcctaggggtactgaagggagtgggaaaggggtgatcattataaactcagctctggatttatcacaggaaaggaccttgggagaggccttgtgattggaacaggctctcctaggggtaaggaagaagaatgtactccccaaaacaacaggtcctgcatatgtgctcactggatctactgttaagaaaacaattctggggaggaggtgtgaatatacagaacacacagaagacactccataaatgctcaggggagccattggaagaaaaggtctttgggggaggatgattaaaatggagcacatgacagacaaggaataaatgctcactggatccattagaagaaaaggcctttggggagtggggctggggatggacatatagtcacctgatcaaggctcactgcatccctgaaggaaaagtcctatggggaggggaaatgggagtgcagaaagttgatctatgggagctcgattcttcatccataggagaaaaggcttttgtgaagaaggcacacaatcaggtacacagcaggtgctccataaatactccaaggagtgattaaaagaaaaggtctttggaaagagtgactggaatggtacacacagcaagtgccagatatctgagcactgtattaactggaggcacaggcctttatggagaggtctaaggttgggtcatgcagaaagtgctcaatacatgcagactgaagccactggaggaaagggtattgcagaaagggtttgagggtggggtatacagcaggcaccagtcaatgcatgcttgctgaatacactggaggaaagaacttttagagaaggctcacactgcaggcagttgataaatgctagatggatccaccaaaggaaaggtctttgaagaagtagctggagaacgggggatacaagaggcactcaataaatgttttctagatccactgtagggaaaggtctttgaggagacggtctgaagatgagtcacacaaagaaggttcaaaactgctcatggaactcactggaggaaaatgatttgtttgagaaggggtttgggggtgcggcacgtatcaggcacttaacaaatgcttcctagatcctttggagaaaaggccctcagagagagggcttggagttggggcacagagaaggcatccaatcaaaactcacaggatccatgaaaggcaaagcttttggagagaagctggggtgggatacacagcaggtactcaatgtttactaaatagtttaaaagggctttaaggacggagctggggtgggacacatagcatagactggacacatgctcacaagacccattagagaaggcctcagggcaagggttgaggagaacaggacagtatcaggctctcaaagaatgctcacaaacctcattgaaatcaaaggccttggggaagggct

SEQ ID NO: 2165 - DNA, 1150 bp, artificial
  synthetic oligo
tctagaaaccatgggtggcctcttcgatttgaaggtagcttccagctgacaaccagtaagaagccagggccctcagtcatgtagctgcaagaaaataaaatctgccaatgacgtgaatgatcttggaagtggattcttccccagtcaagtttccagatgaaaatatagcctggctgacaccttgtgagatcctgaacagaggacttagttaagctatgtgtgaacttttgacacacagaaactgtgaaataataaaagtgtgttgtcttaagctactaagttcgtgggaatttgttatgcagcaatggaaaactaataggatatctcatgccctatttcattgtttcacattttcctcaatgtctactgtataaagctccattttgtatctgggcttctgattattttgtgtactgcatatgtggacaatatgcatattttcatttttcgttcagttgcttctgttccatgaaatagttcttaactactctagtgtatttttttcacttgtttgattccctagtctgcaaattcttcaaactagagagttttaaaccatatggtatttgatgcttttgtccttttattttaagtaaatccttggtaataagggattatattttacttttcattactgcagcgctaaggacatagaacctatttagaatattgaaggtattaaatatatggaggtagtcagaggagaatattttgttttatttttaaaatgtctggtgagagaaactcaaaggaacataaattatacctgaaaagagaaaacaatggctttaaagccaaaatattaggctttctacaataatcccctccaatataatggaaatctagtaaaaacaattgtttaaaaacaagtggcagagtgtatctgcttttggagtgcaaaaaaatatgttccctgaattcagatatggaagattgagagtaattttcgcacagtggacatttaatttattcttgagcccatataaattttgtattgctggaaataggcatgaaaattaagctttctggagaagaacatgaagttaagattggaattgcaaataaactggattttgaaggcaatttcatgaataatttgtggaatgcaaaatcacctacacagtcattttaaagactgatgactcttgat

SEQ ID NO: 2166 - DNA, 1200 bp, artificial
  synthetic oligo
ccaatatttctggcttttgaattcttttacctcctacatgaaatcaataagccttaactaacggtatgactttaccacaggtgcatgaagtatcttcaatgagacagcaagcggtttttacaagatctagaattgctccaaaggtagctcagagaaaagaaaatttcaagacaggaaatcagaagctgtccatggaagggaaaagaaccaataaatggcaaaaagtcacacacatagcgaatgggaaaggactaattacctaagctgggaattgaacccaggctgccagtgtgaaaggccagaatcttagctcctgaactattgcacaaggtgacgactactgcttcttcccaggagtctagagcagtcatttttgagcttgcaaatgattttaactattcaagaaaatttagactagatataacacaatcatgtgtcctttttagtctcaagagtcaaagccctgtaacttaacggcgcaaggactttaaagacaatacagaaacttacatggatacaataacctttttaagtccataatttgaattagcttttaaataacttttgaattagacaaaatttttttttgtcaataagaacatattttccttgtcacattttctataaaactaggaagcaagaaattctttttttgaaaaagtgaaagcaattttattaagaaagtaaaggaatagccggctgtgtggcagcccgcgaggcggtccgcgggagcacactctgtgcagagactgggcggccagcctgcccttgctgtcgctgacggtgactgcgggaggccaggttgtttttcatcattcagaacattgcctgaagcaggtccaccgtgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctccggtaagctcccttgctgagagggtcgatggactacaagttaaagtcactcagctggatcccaaggaagaagaagtgtcactgcaagtaatcaacacccgaaaagccttcagaagctccaccattcaagaccagaagctttttgacagaaactctctcccagtgcc

SEQ ID NO: 2167 - DNA, 1150 bp, artificial
  synthetic oligo
ctattctactactggtttttctagtccttccctctattccaaatcctcaaaattgtccttttccttattgggataattttcctctgcccagatctgggtcctccaccacacttaacactgtctgcaagtgtgtgaattcccattggctttgggccatacaggacacctctagacagactatactgagaagccatgcttggaacggtgcatggggagaggacaggagagggaatttacatacctggctctcactcctggttcttttacttattggtcaaaatttaccccacaggcacgaactcccccacacttctagattgcatcatctgcccctttggcagctgtctgggaagccagatcccacactttgaagtgtagtgtttcatacaatccaaaagtggtagcagaggccaggcgtggtgtcacatgcctgtaaccccagcactttgagaggccaaggcgggcggatcatgaggtcagaagttcaagactagcctggcgagcatggtgaaaccccgtctccactaaaaatacaaaaattagccgggcatggtcgcacgtgcctataatctcagctacttgggaggctgaggcaggagaatcacttgaccctgggaggcagagcttgcagcgagctgagatcgcaccatgacacttcagcctgggtgacagagcaagactccatctcaaaaacaaaataaagcaaaacaaacaaaaaatcaaaaaggtggtagcagaaaccagaaagtccaggtatgtagctaattggcctagttgtacagcagcagccaagggtgaaaactaaatactcccaggcaagccctaagttcaccaagtaattggagtacccatctgtgttagttaattgcctttatctgaaggaaaaataaaactcatatttctgtgacaagcaggtgcttacagcttggagcaaggcatctaggctaaactcccctggtgacagggagacagtgacatcatcttcctcgatgttcacatttcaaaaagacggctccaaggccctaaagaaagacatttatagggaccgggcatggtggctcacgtttgtaatcccaacacttttggaggctgaggctggaggatcacttgaggcctggagttcaagttcaagacattcctgggttatagg

SEQ ID NO: 2168 - DNA, 1150 bp, artificial
  synthetic oligo
ccgtacccggcccaaatttgttaagttactagagttcccaggaaaaatcccatacctgaaaaagttagaaactgacaggaaggatttgagatggcgacctgcctcacatacactccttattaaaactagataacaaatgcaccgcggaggaggggaggggtaggaagaatggaaaaagaaaatcagcgcatgcttactctgattttggaagaatcgaaagagaaaatcagaccgtgcgtactctgagtatggaagaatcgaaagagagagaaagtcagagcatgcatactctgaacttaaagtagccaatcccgggggatgctttaggcgggaaaatcagggtctccacccccagttagaaagttctgtccctggaggctggactgatagacgccacatcagctttgcttatcccgcctactgttctgacttctgattggccagatggagttcaccgactgccctgattggtccatcatccttgcgcagtgacattgcacaatattgtctcctcctccagcaacactttgttgccactgggacaaagtgggtggtcctcaggcgccgtcagattttgaactctctgaagaccatgcctggatctcgggttaaaaatctggattctagtctgaacagcgagaagaaaaaaatagtcggatctgtgatttttctacttgaaagacacaatgttttccagactagcacatttgcagagctttgctgtacttagtcgtggctttcattcttcagtggcttctatatctgttgccactgaaaaaacagtccaaggccctccaaccgctgattacatttttgaaagggaatctaagtgtggtgtgcacaattagcatccttacctgtagccctggagagacgaaaatgtatttacttaacgggatgtgattgtggtattggttacatccgccttggccaatcttcccgcctcggtctcgtgactacaggcgggaaccaccccacccccactcatatttttcgttttttgattttttaaaagagacagtttcgctatgttggtcaggctggtctccacgtcctgggctcaagcgatcctcccgcctcagcctcgggactacaggcatgcaccaccttgcccaggctttttttttttttaagtagaaaccatgtttcg

SEQ ID NO: 2169 - DNA, 1500 bp, artificial
  synthetic oligo
cacgggccactgcaatgggtttttgtggtaggagagatattgggatcgacttggactccaccaaggacaagtggggatttatagtcaagagtagggttggggggagcgggatcagaagatgggaaattacttggaggagacatcaggtgcaggcggattctggctaaacagacttgacaggaattttgctgaaacaggcttaatgggcagagtccctggatggggaggtgtgagccacctcacctgaccaacaggctttgtttaatatgtcagttttcataagtaatctaggtataattgttaaaaatgaataaacgaggtaaatgtgagatacatgtttataaatgaacttttcatataattggaaatctttttttcttgctcttatcatacgaagatgaaatattaaagttgtgttatgttagattaagtaataggtactcactaaatattgggatcatttccaactaagaaaacagctgaaacaaatcgctaaacttaaatacaagtttgttcttggcccttaagttttataaaacacaaaagatatttggatccgttaataaaacgccctgttctacattgaaaattgttctggctggacttggtggctcacccctgtaatcccagcactttagggggcggaggcgggcagatcacgaggtcaggagatcaacaccatcctggctaacacagtgaaaccccgtctctactaaaaatacaaaaaaattagccgggcgtagtggcacgcgcctgtagtctcagctactcaggaggctcaggcaagagaatcgcttgaacttgggagccggaggttgaagtgagcggagaaggagccactgcactctagcctggcgacatagagagactccatctcaaaaaaaaaaaaagttacaacctgttctctctgaagcctagtacctgaaggcttcctctgcaaataagaactcaaaaaaaactaagaacgactcacttcaagtaatcaactttcacaatggttaaagcagagtcctgcttagcaatgcacaaaaattctcctttgtgatccattcattttacttctgttgactttcttgcttatgctttcagacagagtcactgtcctttgaccagacttgagtcgggctcctctgagtcctgtttctgactaggtcccaacctcgggctctgtctttcatccaggaactctgcccatttagcctgtttcagcaaaaatcctgtcaagtcagtttatccagaatccccctgcacctgagttttcctctaagtaatttcccatcttctgacccccggctcctactccctgactacaaatccccacttgtccttggtggagttgaagtcgatcccaatatcactctcccactgcaagaccccattgcggtggtccctatacctatcacagaagtccccgctctgagtaaaatcgtccttacgatctttttttttattttcagagacaaagtctcactctgtaactcaggctagaatgcagtgacc

SEQ ID NO: 2170 - DNA, 1050 bp, artificial
  synthetic oligo
aagtgaaaaatgtagacattaaggggataagggtctcattatgatatgaagacttattctgatgtcttcggaaaagctgtctacaatgtggaatcgtcaacttctcatcctgatttgtggttcgaatgtctctggttatggcattcgacagtttggcgaactctttgtgtggtccatacatcagacacgagacttgttccttaaaatgtatgcagtttggatgggtgcagtggttcatgcctgtaatcctagcactttgggaggctgaggtgggcagatcatgaggtcaggagatagagaccatcctgggtaactcggtgaaaccccgcctctactaaaaatacaaaaaattagccggggatgttgtcacgtgcctgtagccccagctactcgagaggtttgggcaggagaatcgcttgaacgcgggaagcggaggttgcagtgagccgagatctcaccactgcactccagccttggcgacagtgtgagactccgtctcaaaaaaaaaaaaaaaaattatggtgtttttatcttagagtatttgtaaaccaaaaatagcatcctaagcacccccacccttaaccatctgaatggacgtcctcctcagcaagggctcttttaaaattaacctgggagactgttttaggccatgacaggacgtgttcgtcagacatgcctcattatacctctctggcatcaatatcaacacagacttaaatctcacaagaaacgtgttacaacctagtctctctgaagactagtacctgaaggcttcctctgcaaataagaacttgggtcaccacaatcctttatcttaacccaggcattcctttctgttgatcctaggcatgtttgtttgtttgtttgtttgttgttttgagacagagtctagatctgttgcccaggctggagtataatggtgcattctctgccaactgtaacctctgccacccggattcaagcaattctcctgtctcagtctacccagtagttggggttacaggcacccgccatcacatccagctaatttttttgtatttttagtagaga

SEQ ID NO: 2171 - DNA, 1150 bp, artificial
  synthetic oligo
actggggaggctgaggcaggagaatcgcttgaacccgggagatgtaggttgcagtgagccgggatcacgccactgcacttcaggctgggcgacagagcaagaatccattgcaataaaataaaataaataaaataaaataaaataaaataaaataaaataaaataaaataaaataaagtaaaataataaaataaataaaataaaataaaataaacaattgctaattattttagaattatgatctttgagctccatacttgttgcctaatatttgttaagccagttctcccaagaaaataatgttatcccagtgcatcaagatgattgctaatatagatgggactaacaagatggaacttgatgctgaactccaggcaaacctgcctgaaattttttttccttctgtcctctttgttgctcaaatatggcccatgtccctgatctagactcccttacctttcccttgacatgggataaagacaaccggcacaggtccatcctggcatggagtgacaatgaagcctcactttaagatggctgatcggtgaggttttgaaagaaagatgttgatcaaaagagggaatgtgaaagctgattgtgcgaatgaaccagcttctccagggccaatgagactcatttcaaaacaatatgtaacatttttctttctaataaaatttccaacttctgtttgttcgttggacataatgaagaccaccctagtccgtgtatatgccctgaattgcaattttgtgattcccaaatacagcatttgatttagggatttgtctctataatttattttgactttgacacaattaaccagtatgatgtgcttaaaggttgccccaccccctgacagggtgagtattatactgaatttaaaaattctttctaggtagggcatggtggctcacatctgtaatcctaacactttgggaagccgaggtgggtggatcacctagggtgaggagttgaagaccagcctggctaaaatggtgaaatcccatctctaaaaaaataccaaattagctgggcgtagtggcacatgcctgtaatcccagctactcaggaggctgaggcaggagaattgcttgaacttaggaaacagaggttacagtgagccgacatcgcaccattgcactccagcctgg

SEQ ID NO: 2172 - DNA, 1200 bp, artificial
  synthetic oligo
cagaggttgcagtgagccaagatcgcaccattgcaatccagcctgggcaaccagagtgaacctgtgacttaagcaaataaatacataaataaaataattattttcttcttacaacagttacaacatcagaaggtagcttcatgggttcatttctcaggagaatacccattgtttctgcattttcagcaaggttttcttcttctaaaacttcaagggctgcgatggccacttggcagcctagtggattgccaccgtatgtggacccacgttcccctggcttaatggtcagcattatgttatcattccacagcaccgcagacacagagtatcagcccccagaaagggcctttccaaggaggactatatcaggtctgacattttcatgatcaacagccagccatctaccagttctggccactcctgtctgtatttcatcaacaataaacagaaccaagctgggagcacgagatgggacgagggtaagttaaaataccacaaagcttactgttcttacggagactcagctggttcttttctttctttctttctttctttctttctttctttctttctttctttctttctttctttccttccttccttccttccttccttctttccttccttccttcctccctccctcccttcttcccttcccttccttcttccctttccttcccttccttcttctcttcccttcttcccttcccatcttcccttcctgtcttcccttcccatcttcccttccctttcttcccttccttcttcccttccgttctcccttcccttccttttccttctcctttcgcttcccttctcccttcccttcccttcccttcccttcccttcctttcccttcccttcccttcccttcccttcccttcccttctcctttcccttcccttcccttcccttcccttcccttcccttctcctttcccttcccttctcccttcccttctcccatcccttctcccttcccttccttttcttttcgacagtttttctctgtcacccaggctggagtgcagtggtgggatctcagctcaatgcaacctccccttcccgggttcaaatcattgagtgaacccaggaggttgagaccagcctgggaaacatagcaaaaggcagggtggtgcaggcctgcagtcccgaggccgaggcaggaggatcacttgaacccaggaggtagagaccagcc

SEQ ID NO: 2173 - DNA, 1000 bp, artificial
  synthetic oligo
gaggggcctcgtggctccctgagccccctcccctaggacagccagagagggaccctggggagactccgcctcctacaaagctggttgggcctcagtcgcgtcatctggaaaatgggggtggcagggaacttcgccaattctctccacctccttcctggactcccctctcttcctgcccagctcctacccgctctgcccccaggggcccccacccccactcgcctgaatcagcagcacttagcagatccgatcgatgggaaggcgtcagttaatggccccagagcggagtgccacagggaatgatgcagcgctgtcccctccctgccccccagactgtggaaaggcaggagagccaggagtcgggggtaattgctggggagtgtttctctagatggccaagcttccgaagccgcccccttgaggggcgcagcatgggttacagccccagctctaagacttcggctgtgggattggagcacgggacttcctgtttttagatatgaaatgagggtaaagggaatgtagagggggacaatccaggtcccacccccctaccatctcaggcaggccccactccgagggggtagtctctcttatctgtccatatccagtggcctcaaatcacacctcctccgctagagggctctgcttctggatggcaggagcactgattatggaatgcctctggctggctatgggtgggttcaaaccccagctttgccactgacttgctgcatccttgagcaagtgacttgcattgtttcctcagttgtcagatggagagacttatcccaacttgatagcgtcatttggagcattacatgatgtgaaaggtgatagcactggacacagctcacaccagggatgcttaatcttaattaaaggagtgtgatgacaggggcactgtaatgcagggccaggcctagcctttcacccaagatttacccacccgtgtaaacttccaattgcccatttggcacactcctgatttgtccatttc

SEQ ID NO: 2174 - DNA, 1000 bp, artificial
  synthetic oligo
ttagaaaaacctctggaaccactgaatcaaactggatatcattattgatccctcattcaatccttcaatacccatttagtgtcgtctgtccagatgctgcagatacgcctagcacacagtgactgctcagcgaacagtgtcacaatgaacatgtgcaatggccttgaaggccacattgggacttgccctgatcagcaggttggaggtgctccaggcccgaagcttagctgtgagtggggacatgggagggaggttggaactaccactgcagaaggggctctgaacctaggttcaggagagaggctttgaacttgcatgtgtggggagccatggaagtttccaggaaggactgcaggtcccacctggagatgtgcagttcctccttcaggtacctgggaatgtcagtcacaccccagacctgctcagctcctccaaactgctgttcctgtatctgagagcttcaagtccccaaatggcctatctaatacatggggaaactgaggcctggggaggcctggggactgagctagcattcacttgtggaaatagtctggcatcacctgaagaagttagagacatgcaaatcctacgtcctcagattcccctctgagagtctgcgtgcctatgtgaaccaggagacatgtgcgggagtgaacactgcagtgttactccaaacagcaagaaccagaaacagcccaaagggccgttacaggagaatatggacacccaggctgcacatgcacaccatggaatgctgtatggcagtggaaataaatgaacagctacccctacaggcaaacaggaatcacagcaacagctgggagtgacggcgtgaagcagagggacaagaatgtgcactcatgcccggtctgcctggcttacaatcctggctctctgcttgccagctagaactatcatgcaaatcatttaaccactcggtgcctcagttccctcatatgtaaaatggacatggtaacagtgtgtatcccacaggccatta

SEQ ID NO: 2175 - DNA, 1000 bp, artificial
  synthetic oligo
ctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgcta

SEQ ID NO: 2176 - DNA, 1300 bp, artificial
  synthetic oligo
tgtggacacatcaaggctgtgtcagtggggtgaacccatgccccacccatttcacacctcctaatacctaaaggagcctcataaccctgacaaacagggcatcactgctgatctcatttcacagatgtgtagattgacccagggccgtccagcttgtctgtctacctgccacccctactttggggctattcttaacccatcccctgccagcagaggagtgcttaagggatgcttcctagggtccccacttgcctgcatgccaatgacggcatagatgaagaatatcattgcgatgagaagagccacatagggcaaggcctatagggatgggggaggggggcagagaatagatgcacaggctcaggcaaagaactataagccccagaatgcactgctttccctggcctgggcctactgggagatgcagtccatctccaaagtgccaaggactgtggtgtctctcaaatgtgaacatagtgttaagtagatagagtaaggtcagtgagaccagaggtgtgttggaaactgagagcccagaaaaaagagaaaattggaataataatttggaaatgggtatggcatgttgggagatgtagttctgagggtggtaaaggggcaggctgagaagtgtgaaatgggggcgaggtatggtcaaagggatggggtaggggattacctggaaggacttgatgaatgtccagagcaatgtgcggatcccttcacccttactgagaagcttgaccagccgcataactcggaagaggcgaaagaaggtaatggaaatgcgggagctgtcctcagagctctggggtgaggggtgcagtagggatgctcagtttgcatttactccagctatctccctatctcatgctttggccctcccagtacccaaatcactcaggccctagggtaatccggagggatggagggacagagggacatgggaaaagaagcagagagtccctgttattagggtgggctacctcgccaaggtggccaccattctggagggagatatggccaagaaaaaggtgatacaggagatgatgacatcataggcccaaatgaacaaggtgagatatgatggagcagatatagggggtgatggtggggtcattacacaggggacaatgggaaagtttatatggtagtggattaggattaggaaaaagtgggtaatgggaatggaagggagaggagagagtaaaggaggtgatggatcagagacattggagccaatagaggaaatgatggaaccagtggtgtcatagagatgatggagatgagagaaccgatggag

SEQ ID NO: 2177 - DNA, 1250 bp, artificial
  synthetic oligo
cttgggcactcacttgcattcttgaggggtgtgtttggcctcgtccgtgcaggtgtagaatttcccctgtagagaggatgtctgtcaagtaggttcacccttcatcacactcccgcccagacccctgcctggcattccctccagtgtttgccccaccttgaagagctgcaccccgatgcaggcgaacataaattgcagaagtgtggtgacaatcatgatgtttccgatggtccggatggccacaaatacacactgcaccacatgctgcgggcacccaagcatatggctactgaacactacaggccacagtggtcatggggcagggactctggtcatagatgcagctgagggacttgggctggggacatgtggtgatgggtcagggatgtatggttagcaacatgtgttcaagaggcagtgttatgggctagagacgtgtgggcatccaccaggaataagtgtttgccgggtggggatctgtggccacctgtcagggagctgggtctgagaaatgtggccactggtagaaacatatggtcacttggaaggaacatgggtcaggccacatggctagtggtcagagatgtgtatttatgtgtcgggtccaggccgtatggtcatgcatccgtgcaaatggtcagtttgatcagtgatcctggccccaggggcagggcagggcctgggtcctgtgggtttgggtggggtggggttaccttgagtcccttggccctgttgatggctcggaggggccgcagtactcggagtactcgcagaatcttcaccaccgagatggcgctggagctggggaaggggcaatcctcaggcattggccctggctgggccctggctgtgagaggaatggggtgggctggggatctgtcacttactggatgccaaaggagatgagggacacactgaccaccagcagatccaacatattaaaccagctacggcagaaggagccgcggtgcaggaaggccccaaacactgtcatctggggacaggacaagaggctagactcagacctggggatggtgggggttgggggaggtggggatggggacaggagaggtgggctgcaagaaccggtggggagagtgccagggcaactgagggtaggactggggtcccattagtcacctttagtagaatctccacagtgaaaatggaggtgaaggcataatcgaagtaacccagaatctggggtgtgagaaagagcggggagccactgagtcacggctgagggggat

SEQ ID NO: 2178 - DNA, 1200 bp, artificial
  synthetic oligo
aggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagct

SEQ ID NO: 2179 - DNA, 1150 bp, artificial
  synthetic oligo
ctggaaacttggagactctaggaaccacaggacctcaaagaggaagtcacagccctggctcagggagcacccacatctgggttccctgaagggctgcagctcttctttccttctttgcctgcaacgtggcaagcaagaggtgtgtttcagccctgtttgtgttacaactctttcagctctgccgttcggcagctcccgagttcttgtcttgtgtccaggaagaatgaagtacatggacaaatggacaatgagcaaggtgaagaggagctttactgagtgactgaatagctcagaggaaaccctggaatgggtagctcctctctgaaggcaggtcatctttcagatgagagtgttcagctctcagcagcaaggaagccctgaaatgggtagctcttctttacaggcacattatggtgatgtctcccagagtctggctgagtccagggttctcatgggcctcagaggggaggaagtgtgtgctgattggtccatgggcagccatggctgggcccaggaaaaacatcaccagttccccctccggtcagcaggactggaggcctggcttccaggcttcaggccttccccagcctgaaggtagggcttcaccggggacccactactttctaccccagagcctgtctcttatggctttctatggtgcccaatttgtttgtgccaaggagtgcctgcaggccagtgtggagctgccctcagcaccccctcggcctccctcctgtgctggtcagtgcccaaagtctggagagggctgaggcagcagggggctggcatgtcagcactgcctagagtgcgcacacacacggccaggctgtgatagcacctgggcttggccccaaccttgctctgagattggagtgggcgctgggagtgtggagaagccaggcagaaggagcagacccctctgagcctgtggggggacgggggtcttcctgggaccctgagagtgcagatatgcccaggtctgcagctgtggcttggatggttgcagctatgtccaggagggtggggctcccgcctgctcctagcccccaagagcacagggaagcctgggtctggagccatggcagggcagctgcagcagctccctccccaccaacttggaaggggtgcagctcctgcttgtccctggctc

SEQ ID NO: 2180 - DNA, 1400 bp, artificial
  synthetic oligo
caaagagaaaagacgcagactcagctctgagagttggcacagttgctaggcaaagtatcttgggtccccatcctgatagctcaccacctacagatgcaagcccaacaacctgcaacgccagcagaaaaaccagggggaatgtgctctcaatggatccaagccaagctctcaagacacaagataagatggaagaaaaatctcatctttttaaaaaattggtgacccacagcaaagttggttcaaatggagactggtccggtgagaactgtaaactcaccaatctgtgaggttgaacaacaggcttataggacatatgcctgcattttaccctatgattcttcctcttatgacaaatgacacaaaagacagagacaaaagaatattgtggctaccctttgagagagagatggatcagtaagaaatgatcaaagtcacacaaacccagagaactaacttcacacaaatgttttctcctgttaatctaaacttggaaaggagaaatttttaccacctggtcttgaccatagtctacacatggaaatctgggatgctgagttcaggaagaattcttaaccttttaccagtttggtctgggccccagagttttactgtagcctctggggtgagtcagggactttgttggttttgttctctgttgtatccctagcacctagaacagcactcaggcacatagcagattctcagaaaactctagttgaagaatggatgggagccaggcacattgcaaacatcactaagatgcacagatgtcctccaaggtgggcatttgaatgagactcagagaggacaggtgaattccccaaggtcgctgctatggtttgagtatttgtcctctccaaaatttatgttgaagtttaattcccaatttggtagtgtggagaggtaagacctttgaaaggttattgggtcatgaaggctctgccgtcatgaatggattaatgggttaatgaattaacgggttaccatgggagtgagactggtggccctataaaaagaggaaaagaaacctgaactagcacacttagcctccttgccatgtgatacctatctgcactgcctgaggactctcagagagtccccaccagtaagaccatcctaaccagatgtgccccctcaaccttgaacttagcctccagaactgtaagaaataaattgcctttctttataaatcacccggtctcaagtattctgttatagcaacacaaaaccactaagacaccaggcaagtggaacagcattgacttacccaagaagagatactgggctcaccaggtagcatcagtttagctaattaattatgaacagtcttggtgttgttcaggtatttagtgccagggatgtgctaactgcttttcaggtattttctaacttaattatca

SEQ ID NO: 2181 - DNA, 1300 bp, artificial
  synthetic oligo
tgtgcagaagctctttagtttaattagataccatttgtcaattttagctgttgttgtaattgcttttggcaatttcatcataaaatatttgcccatgcctatgtcctgaatggtactaaagaaaatgtggtaccatggaatactatgtagccactaaaaggaatgaggtcatgtcctttgcaggaacatggatgaagctggaagccgtcatcctcagcagactaacacgggaacagaaaatcaaacaccgcatgttctcacttgtaagtgggagttgaacaatgagaacacatggccacagggtggggaacaacacacactggggcctgtggcggtgggagaggagggagagcatcaggacaaatagctaatgcatgtggggcttaaaacctaggtgacgggttgataagtgcagcaaaccaccccatgtcacacgtatacctatgtagcaaacctgcatgttctgcacatgtatcctggaacttaaagtaaaaaaaaaaaaaaaaaaaaaaaaaaggaaaagacagatggggcctactccaaggggaatgaggttcccctcccaggggaaagaaaaacatatcgatgcatagcaatgacaatagtcataatattacacattaataaaacatgtcaatcctctcattcttgtgcacacagctctgtgcacacgtgggtttttttaggacacattcttagaactgtcattgctgcatcaagggagttattcattcaacaaacacctaatgagtgcctgttttctgctgggcactgttctaggaagttgggagatgtcatgggcatgaggtccctgagttctttgctgtttttcttcagaacataagctctctgaactgctcaagtttttccgtccagagtttgtagtgtataagatattatggagtctgtgtcctgtatgaggtctttgaattgtatggtggggtctgtatcccagggagtgaggtccccgagctgttcggggaatctttgtccaggatatgaattatctggtacattgggagatctgtgtctcaggatgtgaggtctgaactgtttgtggctctgtgtccagggtgtgaagtctttgagctttatgggagtctctgtctgtaatatgaggtctctgagctctttgcagggggcgtcggggggttctatgtctaggatatgaggtctttgagttgtctggggattttatttttatccagtggatgaggtctctgagatctggggggatactttttcaggatgtgagattttaaaacaggttgggatttttttttctagtgtgtaagctctg

SEQ ID NO: 2182 - DNA, 1250 bp, artificial
  synthetic oligo
ctttctcctctttacctaagcaaatccatcccatccttcacattccctcccgcccagaggcagagctgcagggcaccagagggaggtgagcagagaggagtgaggaatggcagccagctgccccttggatgcattgtagagttcatcctggctcttgcaaaggaagtggaaaaacaagccctgatggagatgggcatggagcagaggtgggatagtggtgcagaaaaacatcactgggatttttttctgagaactcttggaccttagactaacacaaagtgggaagggattgcagccttgttcagttaacgggcccataccctcccaacaagaatgtaagttctcagagcccaacttgtgacagcatcaaggtccatagaaatggagagcttccgtaccttagaggtgaggccaaatggagttaaattttacagaagcctgcttttaaatacttcaagaaagagaatttaatgggatgcacacacacacacacacacacacacacacacacatgttctgtcttatatgtatatataaacatacctttatattacataatatattgattatattatatagtatttaatatattaaggtaatatatattatataatatataatgtaatatataaatataatatgatattataatgtattatatgtgatatataattatagaaaattatattatatataaatattataacatatattatattaatatagtctagtataatatgatagcttattatattatttataatatataatacataaatattacaatatattgattatatattaattacataatatattatagaatatctataatctattatagataataggatataatattgtacagaatatatattatatatacactaaccacttatatttatatccttgttatagctaagccttgttatccaaggcttctaggatgttaatactaaccagatatctggttaacatccaaaagatcttaattaggaatacacactccatgtgttgtttctttgaagaagcccatacttcagtgggctgccacaaatacttaagatatttccaattgacaccagaggctgtgaaatagcataaggaaaatcacaagtgatttttccttggtgaaatgaatgatgttcaactgatgatgttcaagacatgtggattggctagaaatattatatgggcactacacatgtatatgcatagactacaaggatttaaccagcctactggacaga

SEQ ID NO: 2183 - DNA, 1250 bp, artificial
  synthetic oligo
ggtatcctacaattcatttctgacactaattatcccctgtgagctcagactccacaggttaaggactcaatcccacaagactgccctcacattaggtgccagttacaagtaccaggttgtcacctgtacttttgacctataaatcaggggtttccacaagccactcctcatgtttgataatttgctagaatggctcacaaaattcagggaagcatttacttacatttatcagtttatcctaggatattacaaaggatacagatagtagccagatgaagagatacagaggacaaggtccagaaggatgcttagtgcagaagcttctgtctccatgcagttagagtccaccactcttctggcaagtggatgtgttcatcaattcagaacctgtctgaacctcattgtttaaagtttttatggaggcttcattaccatgtagtcatgattaattaaatcattggccactggcaattaagtcaatccccattccctcttccctccccagaggttggggatggggctgaaagttcccaccctctgatcatatgactggttcctgtggcatccagcccccatcctcccaagagtcacctcactagcataaactcaggtatggctgaaatgagcttattgtgaataaaaaaaaaaaagatgctcttctcactccaatcactcaggaaattccaagggttttagaaactctgtgccaagaaccaaggataaagaaccaatatatatttacaattctatcacaatgtcagaggccactcccctcgtctttgaatgtggatcccttacaggaaaaccattgtatctctcagagaatttgtaacctcctaacgggttatccttgcccactgcccagatagagccaatttatcaagagggggaattgcaatagagaaagaacttaatttatacagaacttgttaaacaggagaccagagatatgttactcaaatcagtctctgaaaatctggggactagggtttttcaagggtagtttgtgggaaggaggaatggcttgggaataagtgctgctgattggttgtggatgtaatcatgaagatgtggaaaatggttctcaagtgcacactaagtctattgctgggtgtggccacaggaccagttggtggttcagggtggagccatctgcagtcagaaatgcaaaaacctgaaaagacatctcaaaaggccaatcttaggttctacaatagtggtgttgtctacaggagtaattggagaagttg

SEQ ID NO: 2184 - DNA, 1300 bp, artificial
  synthetic oligo
cagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaatgaaaaaaaaaagccagaggcgaagttgagggtctttgcaatcccccaaccacttagctgctggtcagaatagcttccatcctgtgtctgctctctcacctcagcagcaggtgagcttagcctcggaccaacctcttgccccccatctccaagcctcgatgggcaagtaatgctttttatctaagccgggaaaagaaattaagcggcatggtgtgtgtgtggtgggggggggggggtgcggggggggcgggtgttcagcctcctttggattgaagtacaatttgaccctcttcggttttttgcatttctgagctttgccgttgggtacagagtttgaggtgattcgggaaaggagtgtgatgagggaggctggcgccccggctttccgcagcctgcagcctccccgagagcaagtcgagagtgccccggcagcagctgggcttcgcgctcgggagctgaggctatctgggcgtctgtctggctcgcctatgctataggagcctgccttgtgcttttagctggatttcccagccatcagcaggagtttgtttttccgccccccccaaacttgttaacgcgcgcgcgcgcgcgcgtgtgtgtgtgtgtctgtgtgtgtgtgtgtgtgtgtcttgggctggggaaattcactgcaacacccacacccttttcacctcctgaagcagtctgacattagagatgggagattctcttgggaagagaacgactgatgcctagcgcagcacctttcccaccacatcggaagactttagaagctctttctgttatagtcacgtacacatacacacaaaccatcatcttagtcagacctagactttagacgccaatatattaccaattgtaattaaaatttgagaagactacctgttaagccacagctgggtggggggagcggacgggggagaaatacctgtaaacctgatttgaaatatgacaagtgaatttatctcccatacacataatgctgcagttgtgggtagcagccttctttctgcagccccttctctagccatctactcccagaccatatcccccactattccctcttcttttgccaacggacactgacctagccagaattttctagaatctgcaa

SEQ ID NO: 2185 - DNA, 1200 bp, artificial
  synthetic oligo
aagtcttgagtgtatctgtgatgaagccttcagtgacactctcatacaaatgccaaaggttttttttttctccgtctctttttcttccttcttctttatggctgcatatattaagtgctcctgtagctctgctgagacaaactgcctggctggtgcttataaagagaagagcttttaaggtttgattaaaacagaggagccaacagtcagaagatgagaacaggacaatatcccttttctctgcagtgccatcagatatatccaattcaccctaacatgggccctggacccaccctgcaggccaacttaaggcagcagccctcccaaatcacttgagtaatcaaagaacatatcccatcaaaggcaggtagcctgcctgacagaagaatcccatgcatggcaagttaccctcctctcttttaggaacccaactggccctgaagctgggattctgccacagattcctggcatcactttagcatagttgagacagtggacaaaggccaagtgaacaaaggccagaaacgtcctctacaaacttgcaaaaaaggcatgtacaactctgaggtacaaccgttctgtggatagcaaatattctgggtccaaactctttcatcaatcgctgttcaaccctgtcccctcaacctctcctaaaacctccagtggtgcttcagcactagcacctcctgctatttagctaaagtgactcctagaccctttgtccaactgattccaatgtcacatttactggctattctagagagaatgctcattttaagagactagctgccatagaagcagcaggagggaagggcagaaaccacaggattcctactttgcgctgattgccactaactcatttcagctgctaaggggaggccctgttgggggagccaggagaggaaatgggttccatgtacggtccactttaaattgttcacaattgcgtgctcaaaaatagtctctactaaacatttagcacgcccattagcacaagccataaagctttaggctttgctgtactgttcgcccaggctgcctaagctgctttcctatggcaaaatgatgaaatggttggcaagtcagatacatgcgggaaggataaaggagctccaaggatggttaaacctggacccaggaagaatggtttaatatgacttctaagcacataaaaaaaatttagagggaaggaccagctgt

SEQ ID NO: 2186 - DNA, 2150 bp, artificial
  synthetic oligo
tgggccccaaggcctgaaggatcccatacactggaagtcaaccacaggctccaatgcaaggcgaatgccgcacaggttattgtgggtgtgtgttgcggtggacgtttgctgaaccctctgctgagatgtgaccaatgttgaaccccacccccccgcaaaaaaaaagtgatatttgctccctgctgaaaagacacatctttctatctccagcctgaacccacatctacaacttcaactgccatttaagcgggttggaagcgggagggcttttcggatttgaggatttaagagaaacaacaaaaaagtggaataaagttcgtaaagtccgttcacttggcaatctggcacctcaaggtgagtcgtcccacaagtcactcttcctggtaacagctccagctgcccctacccctcgccctcacccctacgggggaggctcgctttgggggttctggagcactcaggagagctcctctctcctgtcctcagctgcaacttggcttccagcagatcacagactcctaaaacaaacaaaccctggcggcggcggcggcggcggcagtggcggcggcggcggcggcggcggcggcagcggcagcagcaacagcagtagctccagcacagctgcgctccatggcgcaagtttcctccacacttctcaacgtgcaggaaatctcgccggcgctggggcaggactctggagggagggagaggccgagccgaaccggcggcaacaacgccccaagagctgaatggatgtgtgcgcgtccggccgtgggaagtgtggctggcaaaagccaccaatggcctcatctccgttcccacaccagcccctagccctgcaacctgcctgggagggacggcccgccggtcgatagaggggacaacgctgccaagagagctgccaagccgcgatgactgtcccttcagtccttcactgtcccgcagggacgcagaggcctccaaggagaaatccccaacagcctccacttccttcggcccaaactgagggaagtagccgccccgacgtggggcagcaagggctgccccagcgccctcgcgagtgtgtctgcgcgcaaggttctagccgggggccagttgtgctcccagctcgtgttccagccacccttaggggatgtctgcacctggactggtggcaagacccctccgtgccgctcagagggtctttcgctcccagccctaagtttcaaagttggcctgagggccccgtccagcggcagccttcgcacccgcttgtccattcaaagttaggcgccgttaggacatcagccgccagttcttaccttagacactgtgagcggctcacagtgttccagaccccccttaagggtgaagccccagggtgcccccccttgcagctgcacagggacgtactggaaggacccaggccggttctccatcctcggctgggctcaggcgccgccgggctccttttccgagggggctacgttgcctccgcccccagcagctccgccaccatcgccctccagctctacgccaccccgcaccgccctgctccgcctactctcccggctggagacgctcaggcagcgagcgagcgcaaggaggaaatgacacggagctggagaaagggggagagaggggggaaaaggagaagggaaaaaaagaaaagaaaagaaagaaggagaggcggagggatagcgcgtaatggacaagaaaacggagcaatggggaggggcagtcactgggacctcgcctataggatcgctggggagtgggagcgaggcgaggcctcacatcaattgttacattgtttcattcaagcagggcccctctttggtcctcctctttactgccgggttccccgcccctccagccagcccaggcgaggggaggtgaaagtcgttagtgtggacggcccgcgtggctgagtgggctgaaacgctggtttcctgattagcgcgttcatgtttctctgactgcctttttcttctgaaggtcccgagaacggagacctgggagggttaaaaggctgctaatttgtggaccttgcctagaggggtggaaagcaaagccagcaggccagcggacatagtgaggctgtgtgtgtagactgctctgtgtgtacgcgctaggtgtgtggggtcattatgaaacattgccccagagca

SEQ ID NO: 2187 - DNA, 1050 bp, artificial
  synthetic oligo
cacattttatatgttgtaattttatttttgttcaatgctaaatattttctgattttgattgagactttctttttgtcccatataagtatgtcatttaatttccacatgtttggaaattttcctgttatcattttgtcattgattttaaatttaattatgttaaatttatatctgagaacatgcttcatatatttcaattgtgttacgtgtgctaaattttgtctcattacctaaaatatggtctgttttgatgagtattgcatggacacttgaatttatattctattgttgagtgaaaaattctatgaatgttgattagatccagtttgaaacatcattcatttattctacatcattgctgattttctgtctgtctatcactaagaaaagcatgttgaaatttccaggtataattgtgaattgatttgcctatttctccttttaattctgctagttcttgctttatttgaaattgtgttattactggcatacacatttaatttactgtgtagattgatttgtctgattctgcttttagttctgttcttgctttatttgaaattctgtcattaatggcatacacattttatttaccatgccttcttaatgaaaaaccattttattattgcataatgttcctctttactcttgtaaaatagtatttgttttgcagtctacatctactttgtcagatattactacagtcactccagctttcttgatttttgttttcatggtgtatctttttccatccttttatacttaacctatctataattgaagtgaatttcttgtatataatgtatacttcagtcatttaaagaaatctaatctgacaatctttgtcttttaaggaaagggtgactgaaaacccagtaggagagctttgtggcattttcacttacccttgcctgatccccctttccctggctcagtggcagtctggaagatgtcagcccacattcctgtggtgggtttctggtgccagaggaagcagtatgaacttgttctaaagaagtatggttttctgttttgacctgttgggtgatt

SEQ ID NO: 2188 - DNA, 1050 bp, artificial
  synthetic oligo
caaggtcttgagagatgcctttcatagctggacaacaaagcacaaaacagtgccttgagactgactttttggctgacaggcaggcattcctaccccctctcctctgtcacctgctctgacagttgcgtacacattcccaggacctatttccccatctgcaagagaaaatgattcccaaggcccttctggtataaacccaccagtgagatctcctggggacacccgctcctcgagtattcccatagggcttttctctctcctactctgctcccctccacctacaccccagcgctgcacagcccccgagtccttggcactcagtcaggcagaaggcaacaggctcatgccagaaacggccagtcaaggctggtcactgctggtcatggccaggtcagactggtcaagcctggtcaaagatggtcaaaacctgccttatactacacacgctcaacacagaacagttctggtcaccaaatgaggggatttttcacacattaacaagttttcctattatctgcagacaccggctggatgtcctacaattcagttcaattctatcactaactggagttagcatagatcccgcactttaagggtgcagtcccacaagactgcctcccaccccagaagccaatcttaagccccaggttttcacctgtacttctaactggctatcattcagggttcctatgactcttggctttgataatttgctaggagaactcacagaactcaggaaagaactcaggaaaaacttgttacatttaccaacttattatataatgaaggatatagatgaacggcccttgaagggatacatagggtgaggtctggaaggatcctgagtgaaggagcttctgtccccatagagttggggtgtgccaccctcctggctcataggtgtattcaccaacctggaagcattctgaaccccgtagttcagacatcatgggcaatgtcaggaggactagctcccaggcatcatgtgcctggttaacaggctggtaaacttcctctcctggccactctcaggcccagctagagggagag

SEQ ID NO: 2189 - DNA, 1550 bp, artificial
  synthetic oligo
ggcagtttagagatttctcaaagaacttagaactaccattcaacccatcaatcacattgctgagtatatatccaaaataaatcattctaccagaaagacacatgcactggtatgttcattgcagcgctattcacactagcaaagacatggaatcagcttaggtgcccatcagcagtggactggataaagaaaatgtggtacacatacacctggaatactagggagccatacaaaagaacactatcatgtattttgcagcagcatggatgcagctggtggccattatcctaagtgaattaacacaggaacagaaaaccaaataccacattttctcacttataagtggaagctaaacactgaatacacacggacataaagatggcaacaatagacactggcaagcactcagggagaagtagtcggggggaaggaggcgaagggatgaaagactattacatactatgctcaatatctgggtgatgggatcagtcataccccaaacctcagcatcacacaatacatccatgtaagaaaccagtacatgtaccctctgaatctaaaataaaagttgaaattattttttaatttaaaaaagtgtacacaagttttaaaaattaaaataaatggaattgatatacaatagttgtacatattacatattttaggggtacatgtgatattttgatatatgtatatgatgcataattaaatcagggtaactgggatatccatcatctctaacatttatcttttccttgtgttagggacattacagttctcttctagctattttgaaatgtataacaaatcatcattaactataatctctctgctatactatcaaataatagaatgtattccttctatataacaatatgtttgtatctattaacccacttctcttcatccccctctcttctacccttcccagcctgtagtatacactattctactctctatgtctatgacatctactttttaaggtcccatatataagtgagaacatgtaatatttgcttttctgcacatggcttatttcacttaacataatgacctcaagtttcacttatgttgctacaaatgacagaatttctttctgtttcctagctaagtaatattacattatatggagattccatattttttattcattcatttgttgaggggcacttaggttgcttccaaatcttgactattgtgaatagtgctgcattaaatgtgggaatccagatatctctttgatatactgatttctctactttgggatatatacccagcggagagattgctggataaaatgatagttctattttcatctttttgaggaactaccaaattgttcatcccagtggttgtacaaatttacattcccactaacagtatttgagtgttttagtccgttctcatgctgctataaagaactgcccaagactgggtaatttataaagaaaagaggtttaactgactcacagttctgcattgctggggaggtttcaggaaacttacaatcatggcagaaggcaaaggagaagtgggcactttcttcacgg

SEQ ID NO: 2190 - DNA, 1000 bp, artificial
  synthetic oligo
taaatccacaaaacaacagtggcaatatatgcaattaattactgattttgtatattacgaaagtgaggctcacagagaataagcaactgacccaaggtcacagagtcagtagacagaaaatactagagctggaacatgtgtagtggtgggctagtacaggtttaaaaaccattaagggtggaagatggggcctggaagcacatgctttgtagagtttgctgatttctatggtgtaaatgctccactatagacaattttaaggagtaaatgcacacaattacaagagccagttccagaatgttactacaataggatcctatagtctgaatgtttgtgtccctctccaatttatatgttgaaatctcaactcttaatgtgatggtattaagaggtggagcctttaagaggtgattaggtcacaacagcagagccctcatgaatgggattagtgctgttataacagaggccccagaaagactcctcactccttccatcatatgaggacataagcagaaggtgccatctatgaaccaggaagtggttgctcaccagacactgaatctgctagtaccttgatcatgggcttcccgtcctccagaactatgagaaataaatttctactgtttatacgctacctggtttgtggtattttattttagcatcccaaacaaactaagacataggggaagccattaaccactgagcatcaaaatttcttcactgtgaagtgagaataagaataacttcactgaaaaaaattgctcttaaggcttatgggaataacacaatgtgagagtgcctaatactgtgcctagctcataggtgctcaaagaatgtttgtttagagtcacaatagtaacaaaatagctgctttcaacaataaaacaagatcattactattctccttaactaactcttgaatggaatctactctgtatgagcaacaagtaccatttttaccaacatatttctgtgtggatcattccctaaagatatgttt

SEQ ID NO: 2191 - DNA, 1250 bp, artificial
  synthetic oligo
attttcaaataaccaatctattgctattgagtataaccactatgacttacaatagctcccttgaacttattccccctgtctaacagaaattttctatccattgccaacactccctatgccccccaacccttaacctccagtagccaccatttgtactctctgcttctatgagttccaattttgagactccacatataagtgagatcacttgctatttgtctctctgtgcctggcttatttcacttgacctcacatgctccaggttcattcatgttgccacaaatggcaggatttctttcctttttaaggaggactcatgttcctaccacgtaccccacaactcggggagacaacgtggctccgcctgagttcctcctcccgccagtaggctgagacaggcgtgcggctcgacatgtctctttcttctgtcttgcagatagctctcttccattgcattaggtccaatatcttggaaaccattgtcatctcggttatttcgttgctttgcgggggaaggatcaatgtggtgtttttttcctccaatgtagccagaaatgcaatctcctgaaacatagtttttaatatcccatacttagcaagatcttattcaggttggcagaaagaaaatgggaaagagaatgttcgtcaaagtgtctctaggcaagattttccagtgtgcaagaagatatactcaggcaagacggtttttccggtggacacccttgtgcctgcatgtgatactggaaatacttattttagagatgcgagtcctaaacaactatctctgggatgccgggagcaaactccctgggtcttctagaggcaggaatttgccaccttgtgatgatgagagtttatctcagagaccatgcggctataatttggttttccccagctggtatctgcagctccccccggctgttaacaatttctccaatgtccactcctgggtccgaagtcactgttgcttacatcttttacatcctgacccatgagaacagccttcgctcacttcaagtctactatttaagtgagagacagtgatggcatcaaccccaccaaccgcacacctcacattgggaagagcatgcagactgtgatagtggctcagagtcaagtctcaggaattgtggtggagtcacagaaactgtggtgccattcccagaaaaaccttgatcctggtcataatagaggaggggaaaggtattagggtaactcattgaggcacttactgcggagtcccaggcaaa

SEQ ID NO: 2192 - DNA, 1500 bp, artificial
  synthetic oligo
atggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccgcagcttcctgaacgtctcccagcgctcccgctgtgcgcccaggtccagatccttgggggacggggcgggccccggcgggtacggggttggcgcggagggcagcaggtctctggggcccgccttccggacccgccgccagcggcgcttccgtcgccacctacccagccacctcttggccgccgcgtggctcccgaccccgacttggacccgggggcactgcgcgcggctggcgcccgtgaccgcgatggccgcgcaggcggcgggaggatccccgggccgctttcgcctccgccgctgagcagtggcgcggttcctcactctgcccatggcgcctgcagcctccggagcgcgtgcccacaccccaccctcatttccccgtcagtcgctgagcagcctccttgcctgcgccagcaggattggccccttgttgaatgcgatgtaaagagacccttcccttgaccctatcacaacagccttcgctggcctgaaaggcagtcatgaggcgttcagcaaacacctgccgggcaccagataccctcacctgggcgctgggatgtggagat

SEQ ID NO: 2193 - DNA, 3250 bp, artificial
  synthetic oligo
gagatcatggaaatgaactagaaacatgtatgaaaaggtagatactggcagagtcagtgagaaacacggtctgattatcccatgtttatatgaaactcagttccacttcggtcgccctgggtaaatgaaaaggatacaacgggtgggaaaagtcacatcaggtaaacattaattaaaacagcagaagtaggtatgtcaacattaggtaaagaggacttcatcgcaacgaaaattacaagaaaaataaaacgctacagccgaataaaagaatcaagcccccaagaagactttagaagagtctttccgtgcccctcccacacgcccctccaattacagtgtgtgggcgttcctctctgttcccagagcccctggttcttatttctgtcagagcaaagtgtcccaaggtgttggggactgtatttgcatacacctgatcctaaatgaatgtgagtgctttggaaagcctgatgcatctccacatcccagcgcccaggtgagggtatctggtgcccggcaggtgtttgctgaacgcctcatgactgcctttcaggccagcgaaggctgttgtgatagggtcaagggaagggtctctttacatcgcattcaacaaggggccaatcctgctggcgcaggcaaggaggctgctcagcgactgacggggaaatgagggtggggtgtgggcacgcgctccggaggctgcaggcgccatgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccggacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaactatgtgtgttggtgtgtctataaagtccggcttggctatgtatggcaaggcttggtttttgaaggtacttggtctcagattatttcagaaggtggtggtgactctggcttttgtagtagagaaagcttccccagggtcccctaccttttgatgaggggaattagcagagggtttacacatttggcctctggggacacactacctgtgtttgaatcctggacctgccgcctgctcgctgtataaccggtatcgagtagattaaaccccattcctcaacttgctctttcctcaagaatgttaacagctaacagagtgtttgttcttggggtaaacacagtgccttgccttgactacctgatccatgaatgcttgttttctcaatttcaggcccccaaaactcctcctatcaaggcacccagacaatatgaaaccgcattgtttaggggcgtccatacacatgggaaaaccatgaattaggcagtgaaataatttaagccagcatcagattagggtttaactctatggaggaggaatggctttgagtgggggtggggggaggggagggtgtcctgcattcctgttcctcttgctgtgtaacaaacagccccacagtgagtccatacaatgacgagcgttgtatcatatgcatggaatttcagaggcaggaattcagaaagggcacagtggatatggcttgcttcacatgagtctgggacctcagctgcagaaacctgactggctggggactggaaccatctgaaggctcattcactgacatccctggtgcctgcatggagaggactggaagactaggcctggcgagtggagggcctccgtattaccactccgtggcctttggcttcctcacagcagggtgggcctcccagtagtcaggcttccgacctcatgactcaggctccaa

SEQ ID NO: 2194 - DNA, 1400 bp, artificial
  synthetic oligo
aattacatatatcttaatttgctgagcattttaagtgaagtgctggaaggagaatatagagctccatgccctgatgcgtcaaattgtcaagaaatgtcatccactgttcctaatataacttatgtcattataccccgatatttggaccaaagggacctagaccctatcgcttttgcctgggactccgcagtaagtgcctcaatgagttaccctaatacctttcccctcctctattatgaccaggatcaaggtttttctgggaatggcaccacagtttctgtgactccaccacaattcctgagacttgactctgagccactatcacagtctgcatgctcttcccaatgtgaggtgtgcggttggtggggttgatgccatcactgtctctcacttaaatagtagacttgaagtgagcgaaggctgttctcatgggtcaggatgtaaaagatgtaagcaacagtgacttcggacccaggagtggacattggagaaattgttaacagccggggggagctgcagataccagctggggaaaaccaaattatagccgcatggtctctgagataaactctcatcatcacaaggtggcaaattcctgcctctagaagacccagggagtttgctcccggcatcccagagatagttgtttaggactcgcatctctaaaataagtatttccagtatcacatgcaggcacaagggtgtccaccggaaaaaccgtcttgcctgagtatatcttcttgcacactggaaaatcttgcctagagacactttgacgaacattctctttcccattttctttctgccaacctgaataagatcttgctaagtatgggatattaaaaactatgtttcaggagattgcatttctggctacattggaggaaaaaaacaccacattgatccttcccccgcaaagcaacgaaataaccgagatgacaatggtttccaagatattggacctaatgcaatggaagagagctatctgcaagacagaagaaagagacatgtcgagccgcacgcctgtctcagcctactggcgggaggaggaactcaggcggagccacgttgtctccccgagttgtggggtacgtggtaggaacatgagtcctccttaaaaaggaaagaaatcctgccatttgtggcaacatgaatgaacctggagcatgtgaggtcaagtgaaataagccaggcacagagagacaaatagcaagtgatctcacttatatgtggagtctcaaaattggaactcatagaagcagagagtacaaatggtggctactggaggttaagggttggggggcatagggagtgttggcaatggatagaaaatttctgttagacagggggaataagttcaagggagctattgtaagtcatagtggttatactcaatagca

SEQ ID NO: 2195 - DNA, 1050 bp, artificial
  synthetic oligo
tcttccttttcttggggagtatgtaaaataatgcaagaatgctttctaaatgagtccacgtttattctttggatatttgaatatggtatgtaactctggatacgatctcaaagcaaaaatgatttagattgaagatttttgtaaaaagcttgaaattgaagtataccgctaatacaaatgaactttttaaaagtggtgtgccagaaaacagtaaatcagtttggtaaatatgtaactgtagacatccaagacagagaaaatgaggcctgagttaagggactaagatgaagggagatatttctaaggcgaatcaacaaggagaggtggcgaattgtacatgagggatttggcagagatactgcagctcctggcacgacaagaattaggatttgtaaaaagttagtgattctctctccctgccggtttacatcacaacgtaggtgttgatctagggagggagtcaatgagatagagcattgcagagcttgctagagaggcacaggaagttgcctgaagtgaaggagggggtagcggctgcagaagctaaagcttccgccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtct

SEQ ID NO: 2196 - DNA, 1000 bp, artificial
  synthetic oligo
ttgctcatggttttgaataatgatctctttaatgccttcattgcccatagtgatgtctccttagccactccagacacgggttgcttcatgatttctctcctttttgttcaggcctacacaaggcatgtcttaatcacatcatcttttcaaaaaaccacctctggctgtgttgttttatctttaactgatttgtacttttatcgttatttcatttcttctgctttcttcaggtttaatctgttgttcaacatggttaagaaagatgcaaatgttgtgcctttctttttcatgcaatctagacaattaaaatatatcccataagatttcatcaggttcaaaatactttgcgatttcattggtgatgttttccttgagctatgggttatttagaaaataggaaataaaaaggatgccttttctaaaaataaaatgaagtgaaataaaaaggatgcccttttatttcattttcttgcttaattgccctctgaacttccgggactatgttgagaagaagtagcaaaagcgggcatctctgtcttgctcctgatcttagaggaaaagctttcactctttcgccatcgtgtacagtgttcacaatgagtattttatataggacttttgtgacgttgaggttgtttccttctgtttcaaggagtttgagtgtttttatcacgaagggggttgacttttgtcagatgcttttagtgcatcaattgagccgatcatgtggttttgtccttcattttgttgatgccgtacactaaattagttgattttcattgatcgaaacttccttgcattccacgaataaatcccacgtggtcatgggcctttcatgtgttgttgaactcggtgtgctagacttttgttgaatatgtatgcacaaacattcttttgggaagtgtgtgtgtgtgtgtgtgtgtgtgtgcgcgcgcgtttctggtcctagttcttctctaactgtttagtagaattctccactgaagccatctagtcctgc

SEQ ID NO: 2197 - DNA, 6900 bp, artificial
  synthetic oligo
tgatggtatctggcccagaaagcaaaggggatcctggcccaggcatcgccaaaatctccgtcctcatcccaggtcaggagctcgacttgtatgtcatcccagctccaccgtccaatcagcgcttcatccccgatattcatctgggccctcatctgggccctggcatgttcctcggccatatccacatccattgtcttgaaagcatcatccacagcctccaagaaatgagccttccattcccgggggtctcggttctgattctgaggaggaaaagggcaggcatagacacagagctaccccacactggctgagcacccgcggcccgcctcaccccctcccgtgtgctttgtgcaatgatggcaaaaatcaggaccacagggattgggggctcctactctcctgtgccagacctgggattttgccccatctgtgaccttgtgtagggtgctcaggtgcctctgtgagtgtttggtaccctcactggaatacggggtaatgggaaggaggcctcgaccaagaaacaagcaaggtgtggagagcaccacccccggtgccgggcacccaacagaggcgctcccttacctgggcgatgaatctcaggaccctcatcttgctggtctcatggcgggctcgcaggccccagaggaattcatactcaggtgggttgctgttggggatcttcttgtattccaggtaccttggcatgagaggaaagtaaactttgctgctagccaagcagacctgttgctgaacggatgggttccagggggcccctcctcaacccgatgccgcagctcagctcctggaagaggactgtcctgcccctccagcccttcactcattcccaaacccactcccaggacttctgcctgcaaaagtgaggccttcaaagccttttgccattggtcctccccggaagccatgcggaggtgcagggggtccacatgtagggcatttgtctgtagggaggccacaagtttgtgcccctcatcacgatgaccccagcttcctgttgggtgtgttgtaaacagaggagccattcttcaggccccctgctctgagcacaccccacctcgagggtcttggccacaccccggcggagccctggagaggcccaccagaggaaacgactggagaggaagaaacagtcagccaggagaagcgtgctccaggcatcctcctcaagtcctgaccctttgttggtgtgcatgcgcgcctgtgcgttggcaagtcctccagggacggggagagggtggcccctggcctgaaaatcaggagagttgggctgaggcccttaccagctgggagccatgctcagaggcgtctcctctctgagctccgggttccttaggtgtaaaccagggggaactcttgtgtcagtctacagggcaggtgctcaaggtgatggcggccgttttcacaccccacaccgtgttctcaggtgacgtgagctcccttttcccaagaccgccctggccttcggctccccacacactcgcataccccccactgccactcactcccaggtcagaggcacccatccctccagttgaagatttgggatagggaactgctttctcagccagaccagcacacaaaggatgctcgagtgagagccgcagttagctcaggtgatacttacttctgcttcacaaagtcatctgtgatgagcttcctcagatcgccgaggaatgggtgcctcaccctgagggcaaggaaaggaatccatgagcagagacggtggcaggggccctccctagcatgactatgacttcccagcccccggggagtcgctgtggaggcctgggcatgcagcagaggccagaggactgttggtcagggacgccccaggtagggatttgatggaatccctgactctgactgtctctcttagatgtcatctggggccacagagcagagagagggctgagcagcgtccagcaccgcttccccatccgccctggtgagatcctttgctctctaccgagcccagggcaccccacgcccttgcgccagaccaccaggctattgcaatcccaggacctctttggccagaggatagcaccgaggggaggagctggagaggccaatcatacccagggcgcagtcccatcttgcgtagtgcctcccagaggacagctgcgaggggagaggaggtacgagagtttggcacccagaagatgagactatgggcagccccccagttgcaggtccagccactcaccctcgctggcacggttgccattcatgaagatgacgcccagaatcaccaagaggagactcagcctgggagtgtccttggttctaaaggtgtggaaagagaaatcctgtttagcagctatttgcctgagagacaccaccaggctctcccaactagcctctctcaggtttcccagcttgaggggaactcttcccaggacaggcacagttcactagctgctgacagaccattcgcacctccgcctgagacttaatcgcctcctctataaaacatgggtactaacacttccctgacagggttctgcagaggacagggcgaggcagggagccgaagctctgcaaatggcaaacgtgtgcccagagatggctccagacctttcctgccccttccacatcagcacctacactgaagaggcagctctcccctaggccagctctgccaggcccaggccaggcaggcaggaggaagaggcactttcctccgaagctttggggataaagcccggcagcagcttggggagaactgatggcagcaaggcctcaccccaggctatcattcctttcatccagcagtcaccaggcagccctcgctgtgtgtgggagcggtgcgccgcactcaagccccgtcttcctgcttcactgaaggggtgtgggcagggaagggacaccaccgaggaaggccacgacccgctttccctttcttactttccaaggaggcgagctgaggagtcccgtgtgcagacaagaatatacaggtgttcttccttgtcgatctccttcaggtggatcccaaacttctacgtgggggagaaaacagagtgtgagatccaaaccccatgctgggcatcctgccggcagacagtgattccgggttagaactgctcctcagcaaggaatccaaactcgtgagcgagggcagaagaagacagcacacggaagaccttcgctgtgggagctgacgctggcagaggcgatgagacccacctggccagacggcgagacactcagagagcatgagagagagaagccgagggcaggaagcacgagtcaaactgccagtgcagtggaagctcagagtcggagaggtgagagatggctccagagactgggccttgaggggctgcagggtcaccgcacccccatgcccgctcttcccccacagagctgctcccatcctgcacccaccttttccagggtgtacgttgctcgttcaatgatctcagggaaatgttcatcatattctctgatgacatccttcagcatgtctgcaggagggggaagagttggagaaagcacctgggctgagcaggggtcatagagctgtagccccttggtcagctctgccgagggtgacgcagccaggaccccgtcctgtggctatggagggaccagccgtggcacgcaagcaaagggatgcccacagactaggggatggtgaagggggcacaggctgcctacctgcgcgcttgatggggatcttcttgtagtccttaatcatcaggtatttcaccaacttatttgcctggagaaggaggaacatgcggggaggtcaaggcatgggtgacagcagagacgtggcccacaagggaggagaggaaggagatgggggagggtgggcttcttaccctctcctgcagaagggtcacgttgcgggggggcaggcacagtacgtgccttgagggtatctgggacctcggggccatcgggggccgaggggccaactgagcccgcaccgtcaatgagggctgtgatgctctccaggtgggtgggaccgcgggagtctctctctcctcctcgctgctctcatactcatcatccaggtgcttggactgtatcatttgagagaggagagacccagggctaccaggctccccgtgccaaagcacccggcacgcacctcacccgtagcaggctcttggaaatgagagcagtaccagcagcggctggcatgtgctgcgtgcttactaagtgccaggcactgagccagcctcttctcccaccagtcctgagggtagggactacgtggagtgaaaacatgctcagcaaacttgtgttggagaaacatggactagctgagaggagaggaggggaggagaggggaggtgaggagagaaggaggggaaagaggagaagagaggaagaagggggagaggagagggaggagaggagcaggaaagggaggagaaggaaaggacaggagcaagggggtgtggaggtggcagggggcagggggatctcaccttcttggtcctcttgcctcccatcctggcccagggctcagcactgtgctgagcagtggcagcagctgcaccctccggctcagggatgctcgtggccatcttggccttggcagcagctgctgccacaacattctgaggctccacccaccgagtcttggccagcgccttccccgacttggtggtcttgggccgggtggctgccacctccctgccaggtcccgtctggggcacaccagaggcagcactggggccctctgtggcagcctcttgggctggggcaggtctcttggggcgcgggaaggccatgccactgacacctgccggctgagtgaaatcgaagacatcattctggcccaggaaggctgtgctgggccggttggcgtccacctccctggcacacggagcctgagagaaagcacaggcgctactagggccctcagtagcagcctcctgggccggggagcctgtctgggactgtgcggaggttgccggagcctcgggggcagccatcttactggtgactaacatctgggaggtctgcggagaagcaaggggtggctcaggggtgggcccctgagcctcggcggcgtaggtcgtgggctgggtatcctctcctgagacctgcggcgtggccacccggtggctagcgaccacctgactgaaggcggtacgggcagcggcggcagcggcccgagccgcacggttggaggcggcggcgcgggctacgttggcagcacgggcggccgtctcattggcaagtgtttccggatccagctgcaatgcctccaccagggtctgggccagcacagggttttccagttcccagggctcattctgcaaggccagagagaggggttggggaaggcaggccactcgacgacatacttgtgttagcttccctgtgctggccagcctcttcccagcagtcagccctgaacaccccaagaccttcccaaatcttcttcttccgagcaggggagggaaggcttgggaagctgggcagtcctttcccacacaaccctcctggctcccccctcctccctcccccattcacaggggaaaggcccaggccagcaggtgtccaggaaggggcctcaccgataagatgcgaaggcctggacccaagcttccgaaggctctgaggatatggatgtcaaagctggtgagggtgccatagccaccaaacgcaccgaattcttcatagtcgttgccttcaaccatctcttcctccccgacttcgtcgctaccctcatccatgtcttcaacactgtagctttccgattgcacgctgaagcttccctcagccatgctgcgggtcccagggagatgagagctcagcctgagagggagggtgaagcagctgcagggggagggggcgggatccaatgggaggcgggatctcccgggaggtgaggggcgacaatcatcaggttactaggcaatattaggcagtagggggcggggggggggaggaggagcgggggggagacggtttggctttctgatggggtagacctggtcagggacagagcccaaggaaagggacagaggaggtcgcaggaggcgccgcactgaaagcggagtttaggatgggcaggctcgccatcccagcggctagatttgacgagggggtgttctggagggctggggtccgaagagtcccaaagggaatgcattggggaagagagaaacaaagggtttggatttacgggccagagaaggggaccgggatgaagggggagcagatgggagagctcagacaacagggacagtggcaagccgcaagctctgcgaaacagaaccccagggacctttggctaggtccgggcggggggcctaggtggggctcagactcgagcactagaggcggatggagtgggggcctcagacctaggtgaggctccaatcggagcgctgcagatctcaaacgcgaggactgggcactccaggaagggggcaagcggtcagctcggttcgagtaatctaggagtggttggggtgggggtggggcctcaggtccaagggagctcagctcggagcacacgggtctgctaaaggggtgaggatcctgggctccggtttcagtagggctcagatcggggcgcctgggtctgatggtgatgggggctcctatctagaccttgggtctaatggggttccggttctgagtgcttgggctttgttcagatccggaggcggagggagggcgcagcgtgtcgggttccactcgccctctcccggtcctgtctggggctggatccttaccttctcgggaactccaatggcgtccgtcctcagcaccaggaaccccgcagccgcgccctcgcctactgctgccagcacagcagcccggaccaccccgccccttttctccgtgcaccccccgcggctgggtagcctgcgcatgcgcggacccctccagcccgcccgctttcccaac

SEQ ID NO: 2198 - DNA, 3000 bp, artificial
  synthetic oligo
caggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgtttta

SEQ ID NO: 2199 - DNA, 1100 bp, artificial
  synthetic oligo
ggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaatttggatgtttcttcctttacctgcacacccattgctatacctggccacgcttgggcttgtagcaaggaaacttcttcaggctctctggggtaggtgggccccacctctgccaaaaaggcccacagggacaggtgggatgctgggaggtgcggaggttggttacgcctgagtgcgtgagcaggagtttggagaggccccagtgctcatcgttatgtgattttctacaaaccttgctcagcagccccagggacatggcaagagtcggggccacagcaggggcggggtggaaaattgcagcttggtgccactgcccctcccgccgagggacagggtccaaggctctcaccaggacccacctcccacaccccctccttggagatgatgttccggaacccttggctcatcatccacacagttcaggaccccgtcctcggtacagagtctgacggacaatgaggtgggccccgcagtgatgttcgcagccctccagtgggtagaaggaggggccgtgattgctgagggagcaggatgtaataaaaacaacgcacggtgcacgcgtacacagccccttgcctgtgacggaacggcggcctgtttggagcttcgcagcccttctcccccagcagcagggctctcccagtgaggacaacaccaggcctacctaggtcctggtgtgttcaagggctgggtgatgtctggaggggtctgaggtagggctgcacatgcttcaggtac

SEQ ID NO: 2200 - DNA, 1600 bp, artificial
  synthetic oligo
gaaacgtacacgctgccaagactgactcctgaagaaataaaaaatctcagcagatctcgacaactcataaggagacttaaccagtattcatcaacctcccaacagagaaaaccgcaggactagatggcttcagtggagaattctactaaacagttagagaagaactaggaccagaaacgcgcgcgcgcacacacacacacacacacacacacttcccaaaagaatgtttgtgcatacatattcaacaaaagtctagcacaccgagttcaacaacacatgaaaggcccatgaccacgtgggatttattcgtggaatgcaaggaagtttcgatcaatgaaaatcaactaatttagtgtacggcatcaacaaaatgaaggacaaaaccacatgatcggctcaattgatgcactaaaagcatctgacaaaagtcaacccccttcgtgataaaaacactcaaactccttgaaacagaaggaaacaacctcaacgtcacaaaagtcctatataaaatactcattgtgaacactgtacacgatggcgaaagagtgaaagcttttcctctaagatcaggagcaagacagagatgcccgcttttgctacttcttctcaacatagtcccggaagttcagagggcaattaagcaagaaaatgaaataaaagggcatcctttttatttcacttcattttatttttagaaaaggcatcctttttatttcctattttctaaataacccatagctcaaggaaaacatcaccaatgaaatcgcaaagtattttgaacctgatgaaatcttatgggatatattttaattgtctagattgcatgaaaaagaaaggcacaacatttgcatctttcttaaccatgttgaacaacagattaaacctgaagaaagcagaagaaatgaaataacgataaaagtacaaatcagttaaagataaaacaacacagccagaggtggttttttgaaaagatgatgtgattaagacatgccttgtgtaggcctgaacaaaaaggagagaaatcatgaagcaacccgtgtctggagtggctaaggagacatcactatgggcaatgaaggcattaaagagatcattattcaaaaccatgagcaactttatgcccacaaacgtgaaactttggatataatttacacatttcaagaaaatacaacaaaatgacagaaaacagactaaacatctgaattgtcctacaaattctaaacgggcggaatctgaaggaaacaacagcaacagccacaagaacctacggactctgatgctgccaccgattaattctacaaaacgtttgtgaaggaaggaatatcaatcttaccttcttgccaagtaacataaaaaacgggaaatgcttcccatcccgttttatgagggaaaaaccttaaagggcatggtaagaaatgaaatgcacaggcctatcttttacataagcacagaagaagaaatcttgaataaagcattagcaaaacaaatcagttaaatctccaaaaaggaaaacgtatcacaaacaagtcaagagtattctagaaatgaagcggttcagcgcttgaaaaatctatctctcagaagtaatgtatgaaggaga

SEQ ID NO: 2201 - DNA, 1150 bp, artificial
  synthetic oligo
cgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcga

SEQ ID NO: 2202 - DNA, 1200 bp, artificial
  synthetic oligo
gcagtatatcgaagagatatctgcactcccatgtgtgttgcagcactgttcacaatagctaagatttggaagcaacctaagcgtccagcaacagaggaatgaagaaaatgtggcacatacacacaagggagtactcttcagccataaaaaaaattgagagccactcatttgcaaaaccatgaatggaactggagatcaatatgttaagtgaaataatccattcacagaaagacaaacatcaattgttctcacttatttgtgggatctaaaaatccaaacaattcaactcatggacacagagagtagaaggatggttaccagaggctgggaagggtagtggggagcttgggggatgtggggatggtaatgggtaccaaaaacatagttagaaagactgaataagacgtcctatttgatagcacagccgagagacggtagtcaataagaagttaactgtatagaagaatgatgctggctactgatcatgtgccggctactgatcatgtgccacctcctggccatgggaagtgagtctggagaaggccatgagaggcagttctgggctcagtagtgaggagggtgtgacactgcaaaggacaccttgcctttgcccaaaccggatggacgtggtgctcaccccacctctcactgctcagctccgtttcctctccacccgcaccctggatctttccagagcaccgggcctcctccagcctagggacccaactgctttcctaagctgctatggaactggcctgaggtcccaggggctgtgcattgtgctgctgacctccgctctcttcagccagagtcccagttcagccgctttctggagaaatccgtcgcctgggcccacgcacaaattcagagcttagcaggtgttgacatgtgctccgctttcctggaaaggccactctccccatcacctttttcacagatgtgaacgttgaggcatgagggagggtaattactggtttacccaggggatgctaagaacagaggagaaaaccccagtgctcaggtgtgtgtctgtctgatgggccatgttcaccaacccatttaagtggacggggctgctaatagatacctaaagatttggttttaggtattttacacttgaaatcattggcttcatctcaactgaggcctgactgcccagtgtctcaaagatacaggtcatgacctgatccttcaggaaca

SEQ ID NO: 2203 - DNA, 1000 bp, artificial
  synthetic oligo
atatctttgttgagtttctttgttgcttttactgaatccaattcctttaattgatatacggctatatatgtcgtttatttgttttttaacgtttcatttatgtccatttttatgggtatttagtaggcacacatacttgacatgttttgatgcagcttgcaatttgaaatgaggacatgatggagattgaggtattcctcctctcaagcatttatccactgagttgcaaataatccaattatactgttcatgttattttaaaatgcacagttacactctttttttgtttgtcttttttagcacttgtccactgtttattcattggaaggaaggcccggtcctaggtagactcgacctcccccgaggaaccttggagccaaaggcaggaggcttccagaatgcttagactctgatcctccttactatcaccctgagacctgtctcaccaaagccttcttctgtccatggttttctcactggatctacaagggaatccccccacaagtctggggtccagtgtggtcactcctgatggttttcaagaaggggaaggccaggaacctagggaaatacctcatttggcccgaccacaactggccagagcaggacaaacatgccatgccatgtcaggcgcccagttacccagctggagggaaagtcagtcctgagagggtggaaggggccagtcacaaatcccggatagatagtgacctgggctccacaggtgagctgggctctgatggctttccctgcctttggaaacaaggaggagaagttttttgcagaaaaagcctcttttccttccagaactgctgttttatgacagctgtttcggcagtgagtcttgtgtctgttatgagggtgggtccccctcttggccctgctctacagaaaatgatggagcagggcaagctgtcctcagtgaatgtacaccagaatggcctggacgtgagccacgccttcagaaaccatgcgtgctccaagagcgctacagcatcaa

SEQ ID NO: 2204 - DNA, 1250 bp, artificial
  synthetic oligo
aattcaaaagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttttaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacgatttccaatattatcaaatacctgggaaggaagtgaaccaaagatgagc

SEQ ID NO: 2205 - DNA, 1900 bp, artificial
  synthetic oligo
tgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaac

SEQ ID NO: 2206 - DNA, 1250 bp, artificial
  synthetic oligo
tacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattca

SEQ ID NO: 2207 - DNA, 1200 bp, artificial
  synthetic oligo
tcagaagggggagtaatatgagatgtacacgggccactgcaatgggtttttgtggtaggagagatattgggatcgacttggactccaccaaggacaagtggggatttatagtcaagagcagggtggtggggagcagggtcagaagatgggaaattacttggaggagacatcaggtgcagggggattctggctaaacagagttgacaggaattttgctgaaacaggcttaatgggcagagtccctggatggggaggtgtgagccacctcacctggccaacaggctatgtttaatatgtcagttttcataagtaatctaggtataattgttaaaaatgaataaacgaggtaaatgtgagatacatgtttataaatgaacttttcatgtaattggaaatcttttttctcttgctcttatcataggaagatgaaatattaaagttatgttgtgttagattaagtaataggtactcattaaatgtcgggatctttccaactaagaaaacagctgaaacaaatcgctaaacataaatacaagtttgttcttggcccttaagttttataaaacacaaaagatacttggatccattaataaaatgccctgttctacattgaaaattgttctggctgggtgtggtggctcacgcctgtaatcccagcactttgggaggctgaggcgggtgggtcacgaggtcaagagatcaagaccatcctggccaacgtggtgaaaccccgtctctactaaaaatacaaaaattagccgggcacggtggcgggcgcctgtagtcccagctacttgggaggctgagtcaggagaatcattggaacctgggaagtggaggttgcagtgagccaagattgtgccactatactccagcccgggcaacagagcaagacttggtctcaaaaaaaaaaaaattaaggttactaaaaattaaaagttcttagtatatgtagttccatatacaaaatatacagaaaacaatttttatatcaaaaaattttgtgtggtctgagtgataaatatatttttatcctaaaacaaaatgattggttgccttagcataaaaaaaaatagtttagcccaggtgcagtggctcaggcctgtaatctcagcactttgtgaggcagaggtgggcagttcctgatgtcaagagatcgagaccatcctgaacaacatggtggaattctgactctactaa

SEQ ID NO: 2208 - DNA, 1750 bp, artificial
  synthetic oligo
tttcagcctgtcttggctttcagcgtgccttcctcactaagcttagccatttctagcttgtgatttagagtgagagacatgcgactcttcccttcctttgaacacttagtggccattgtagggttgttcattgtcctaatttcagtattgctgtgtctcaagaaatagggaggcccaagaaaaggaaggtaggcaaggaagagctcatcggtggagcagtcagaacacacacaacattgatcaattaagtttgtcatcttctgtgggtgcagttcctgttacccctaaaacaattacccacaacagggtgattattgtcagtaataacctaattgcacatttaaaaaaactaacacagtgtaaatggattgtttgtaacacaaggataaatggttgaggggacggataccctatttgccatgatgtgattattatgcattgcatgcatgtatcaaaacatctcacgtaccccataagtatatagacctactgcgtacccacaaaaataaaaaaaattattttaaaagactaaagaacaacaaaacaatcgcaatcataatatcaaagctcactgatcacagatcactataacagatataataataatggaaaagtgtaaaattggtgagaatttcaaaaaaaaattgcagtatctgcgaagcaggataaaaatgaggtgccataaaacaaggtttgccttgtgcccttaacaaatacgtgcagcatgaaaggaggtatgggtgagtgttcccataagtgaagaggctgggaatctaaacctgacaacggaaggagccagaagctaaaactttaattggtatttgtggtgtattggtgtggatctaaggcctcagcctctctaagccagagaatgtgaaaaactggataaagaaggcccatgggcacttggtggtggggaggcatctccttttttgagaaaacagagcctaacactctccaacccacccaaccctcactttccaactattctccatcataggacccaaaagggggaaacatgcctggacccacagactgcgtgagagaaagcagctggtgatttatgaagagatcagcgaccctgaggaagatgacgagtaactccgtaagtgaaccttccgctcatcccccacatccctgcagatgtgctattctgttatgatactggtatcccatctgtcacttgctccccaaatcattcccttttctagggtacagcattgaggctgaatgatgagatttcccattctctttctttctttctttctttctttctttctttttttttttggagggattcttgctctgtcgcccaggctggatgtggtggcccgatttcgcctcactgcaacttccgcatcccggttcaagcaattttcttgcctcagcaacctgagtagctgggattacacgtgtgcaccccacacacccggctaatttttgtatttttagtagagatgaactttcaccatgttggtcaggctggtctcgaactcctgacctcgggatccacctgcctcggtctcccaaagtgctgggtttacaggcgtgagccaccgcacccggccgatttcccatgctctttctactctctaccctgtatatccagggatgctccctacccaggatgctgtgggttcccaaaccccaggtcagccctgatatgcgggccacaccttcctctagcctaggaatggatcacccaggcgaagaagtcactgtggcatgaacagatggttcacttcgagga

SEQ ID NO: 2209 - DNA, 1000 bp, artificial
  synthetic oligo
aaaagtggctactgccagccaatctgtctgtggtgttggaggggaatctggctgattcagacgtttcaaatgaacttttaaattaacctacatgatgattatcctaaggccgtttcctcctccgtgtttttttgattcagggtttggagtttttcagaggctttgttacaaagagcatctcctggtcgggcacagtgactcacgctgtagtgccagcactttgggaggccgaggcaggcagatcacttgacgtcaggagtttgagaccagcctggccaacagggtgaaacccccgtctctactaaaaatacaaaaattagccagccgtggtggcgggctcctgtgaattccagttactgcaggggctgaggcaggagaatcccttgaacctgggagacggagggtgcagtgagccgagatcacgccactgcactccagcctgggcgacagcaattctatctctttaaaaaaaaaaaaaaagaaacgaaaaagaaaaaaagaaaattcacatcacaggcaatagatagctataaaaggatactttatgaaagatttcacaggagagactgatggaaagaaagaagtatatatcttacagagctaagcagttcactgcaaaaatcaacggaactgcctttttctccaaaaatagtacccctaagctatattactactggttcttctagtccttccccctatcccaaatcctcaaattgtccatttccttattgggataattttcctctgcccagatctgggtcctccacaacacttaaccctgtcttcgggtgtttgaatgcccattgttttagctcaggttcccaaggaaacaggctttgggccatacaggacacatctaggcagactatactgagaaaccatgcctggaacggtgcagggggagaggagaggagaggcaatttacgtacctgactctcactcctggttcctattcttattggtcaaaatttaccgcacaggcacgagctcccccacactt

SEQ ID NO: 2210 - DNA, 1800 bp, artificial
  synthetic oligo
tcgcctgggtgatccattcctaggctagaggaaggtgtggcccgcatatcagggctgacctggggtttgggaacccacagcatcctgggtagggagcatccctggatatacagggtagagagtagaaagagcatgggaaatcggccgggtgcggtggctcacgcctgtaaacccagcactttgggagaccgaggcaggtggatcccgaggtcaggagttcgagaccagcctgaccaacatggtgaaagttcatctctactaaaaatacaaaaattagccgggtgtgtggggtgcacacgtgtaatcccagctactcaggttgctgaggcaagaaaattgcttgaaccgggatgcggaagttgcagtgaggcgaaatcgggccaccacatccagcctgggcgacagagcaagaatccctccaaaaaaaaaaaaaaaaaagaaagaaagaaagaaagaaagaaagaaagaaagaaagaaagaaagaaagaaagagaaagaaagagaatgggaaatctcatcattcagcctcaatgctgtaccctagaaaagggaatgatttggggagcaagtgacagatgggataccagtatcataacagaatagcacatctgcagggatgtgggggatgagcggaaggttcacttacggagttactcgtcatcttcctcagggtcgctgatctcttcataaatcaccagctgctttctctcacgcagtctgtgggtccaggcatgtttcccccttttgggtcctatgatggagaatagttggaaagtgagggttgggtgggttggagagtgttaggctctgttttctcaaaaaaggagatgcctccccaccaccaagtgcccatgggccttctttatccagtttttcacattctctggcttagagaggctgaggccttagatccacaccaatacaccacaaataccaattaaagttttagcttctggctccttccgttgtcaggtttagattcccagcctcttcacttatgggaacactcacccatacctcctttcatgctgcacgtatttgttaagggcacaaggcaaaccttgttttatggcacctcatttttatcctgcttcgcagatactgcaatttttttttgaaattctcaccaattttacacttttccattattattatatctgttatagtgatctgtgatcagtgagctttgatattatgattgcgattgttttgttgttctttagtcttttaaaataattttttttatttttgtgggtacgcagtaggtctatatacttatggggtacgtgagatgttttgatacatgcatgcaatgcataataatcacatcatggcaaatagggtatccgtcccctcaaccatttatccttgtgttacaaacaatccatttacactgtgttagtttttttaaatgtgcaattaggttattactgacaataatcaccctgttgtgggtaattgttttaggggtaacaggaactgcacccacagaagatgacaaacttaattgatcaatgttgtgtgtgttctgactgctccaccgatgagctcttccttgcctaccttccttttcttgggcctccctatttcttgagacacagcaatactgaaattaggacaatgaacaaccctacaatggccactaagtgttcaaaggaagggaagagtcgcatgtctctcactctaaatcacaagctagaaatggctaagcttagtgaggaaggcacgctgaaagccaagacaggctgaaagctcggcctcttccaccaaacagccaagctgtgattgcaaaggaaaagt

SEQ ID NO: 2211 - DNA, 1450 bp, artificial
  synthetic oligo
tccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaa

SEQ ID NO: 2212 - DNA, 1250 bp, artificial
  synthetic oligo
aaaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcct

SEQ ID NO: 2213 - DNA, 1250 bp, artificial
  synthetic oligo
gagatggcttcccagagaagagagtgttagagatcctgggtcccaaatgccctgtccagcccctggagggagaggtgggcttcaagaggaagtttagaagatttaaagagagtttatttgtctgagggacaggctgatgggctattacagcacacacgtgataataaacacctgttactttgaatttatgtatttacttatttgtttagtattggcaatacatgccgaatggtggtgatacccaaagcagacaggtaaaatcaagccactgtatgggcaagtcgagacattcccattttacttgggaagacctgacaagaaaataccactctgcagtataaaaggagaacattctcctagactcaacaaatgaaactaattagttattttttctaattattcttattctcctattacagatgaggcacggtaagcacagggaggttaggtcagctctgcgaagtcttcaagtcataagtcgttgagtcccatagcaagtactgctcagcatgtcccaaagtgaacgcacccatccccactcagcacgcctgcccctcctcctgtgctgcctgactcagtgacaggcaccaccctctacccagcagcttgggccaaagatcttgaaagccatccttgattgctgcctcttaccacccccacagttgaccgagcctggccagttagacctcccaagtttttctaagtgagaccttgacactgactcctctccatcaccacaggaagttccctagtccagtcaccctcatctccctcctcgatgaccaccaacaattcatagctcatcttgctgccagtcttgaccccttcccacgcattctctgtcccagtgagtggggcacctttcttgactgctaatctggtcatgtcaaaccttttcaaattctactagggctgcctgctgcccttaggataaagtccagcctcctggattaggggtatcaggccccagctactaccaggcctctctctgtctagcgtgcacgctcgctctctcgctgtctctctctcgtgtctgccgcctcacaaccgcccttccctctgtctggcctgcacttgctccatcaaccgctgcctgattgctccttaccttcagctctcaagtgaaggagagcaaattatactttacctagggagcaactggatgaaaaggcatgcttagtgggtttgatatttttactgaatagcacatgatggagattcatgaaaattcccccaatgggccaaccaac

SEQ ID NO: 2214 - DNA, 1000 bp, artificial
  synthetic oligo
agaaggaatcaatgtatgtcgtacatgcattgattgatgtcttatgtctccctaaagtgtataaagcgaagctgtaccctgacgaccttggggatgtttcgtcaggacctcctgaggttgtgtcaggggcacgtccttaaccttggcaaaataaacttctaaattgattgagacctgtctcgggtacgttttggttcataacttctaacgtttcctagattcccttgtggagggtttgctgtctgccacctaccacgtcctcttcggggaatgtcagatccagggcagggatttctgttgatttgcttccctgaggtatccctacacctcaagcagtgcctggcacgtagaagactttcatacatatttgttgcctgaaggaacacatatgcctcccccactagactgtgagaccattcagggtctcgttctcccctgtatgatggagccctctatgcatgcttgtgtcatggtgcaaagagcctcacaaaataacagaattaaaccgtgcatgtcttagagatggaggagatactctggaggtagtttctactttcttcagcccaacacacatttctcttgaatggtctgtgcccattactcctacatttcagctgagacggtctcgggcccacacctccccctgaccacagatggcatctacctgtgtcccctcccttccctagccccgaattctgcattcagaagcaccgtgcgtttgcaggaaagggctgagatgccgctctgtagatcctcatcatgtaaaggtgaagttaaggtttgggaagatgatccaaacagctagagactcctgccatcccaccagggcacaggggatcccgggtttgatgcatgtgttctgggagagctgcaagagggatgttgtgtccaggttattttctgggtgtcagtgacatcttgcaggagacagaccacacgacccaggaacacatgggcaggtcctgttcatcgctgagagagagggtccctgctctgtgtc

SEQ ID NO: 2215 - DNA, 1100 bp, artificial
  synthetic oligo
ttttgcttctttcaaaaaaaatttttccctgccttgttcattggaaatacccagaagcagtgacacctagtatcaatgaacatccctagcacctgtatcttggtgtctgaatacatcccaactaaaacgaaccagggctccttggagaaatggctaatttcaggtctggagcaggaaatgtccaacatgagcctgagacatcttttcctaccagaaaccaagaaaactatcaaagactgctagtgtcatgttaaaaaggcacagaaacaaacttgaaagggctcccactggccaaatatggggtaatttgaacatcaaacagaatgataattgcaatggattgaaacacactgaatatttttttaaatgagttcataatggcactaaaaacaagcagcaaaaacaaaaaacataaaaacctcatttgaaccattggaaataactaggacatcaagtccttcctctgaaaattggcatttataatgacaaaattatatatttattttgtctttcctatgtaaattctatcttggggtaactccaatggcccaagttgatgaagggaagtttttgtttttgtatttttctgagacagagtctccttctgttgcttgagctagaatgcaatggtacgatcataactcattgcagcctcaaattcctgggctcacgccatcctccaacttcacccttccaagtagctgggattataggcacatgccactgggcccccttaattttttaatgtttgtagagatagggtgtcactattttgcccaggctggtctcaaattcctggcttcaagcgatcctacctcttcagcctcccaaagtgtttagattacaggcatgagccaccacgtctggccagaaatattttacttgtagagaaggctggttaataaatgtagaaaaatgacagaattagaaagatcaccacttgcaagtcctaataaaacaactgattcaggcaacaatcatcaatagatgaaaccattagatgaaaggttaatggggaaatttaccatggagagatgaggcttttaccaccttaacccaccgataaatcttaacatcactaacagcaggaccaccagaca

SEQ ID NO: 2216 - DNA, 1800 bp, artificial
  synthetic oligo
aggagagagggagagagaaaggcagagaaggaaggaaggaaggtaggtaggtaggttgaattacctacattccaaacacctaagcataactagaatatgtcttttggtgtagggtatatgtttttgtatatgtccttccagttttttcctatatgtagtattttgttttccctccacctttctttttagccaaacaatctattgtatggcactcttctgaaaaggtcaactgatgtgtgttcttcctgttagactgagttttttggggactggatccaggactcattcatctttacatcgccaggacccgggcagggagctcagtaaatgtttcttgagtgaatacaagcctcagtggatgggtggtgaatgagtgcatccccagtggggtgaagggtcctgggccagtcttctccaattccagcctcattatccctccctgataccacccccaagagccacatcccaaaccctcccctggcgctctcttgcatcccgactcccattcccaaccagatgcctctgttgcaccttcttgtcctgcaggtctgtggagagttcatagctgtccgatagggccttggagcgctttatctcctcctcctcctgcttcctcagggcgacactggctggctggaggcgtgcccgctgagcccagggaaggcccactccagcaggggggccccccatgtggctgctggaggggggcagctggctcagccggtaggggggttggctcccaggactatcaaccgctgtgctcaggtcactgcctggggcatcaccctccacactgtggggatgagataagatgagccaggatgtggggacaggacaggggcctactgggccatactgagagtgggtgagccagatccctgccccccatcccatccaccccagcttcctcacagatatagggacccaacacttacaggccacggtgagtcctagctcttggacgtctccccactcccacccaagtcccctcccttccagcccccctgcctttacggcaagatcctcttagactcctttccctcaaggctctgcctggtccccagtcctcctcacccctcacagccttctcccctagaccactctcctcccagtcttgtctcctcatgccctttcttctgccccctcacagctccacccctccccacagacctcttccccttacagctccatcccctcctggccttgtccccaacgcagtgctcgctgtgatttccctcccagtccgattcccagcaccaccccagactagctccttcaaagcgccaccccctcccagccctgtcccagctgtgtgaggcccacccctgcacacagctctcccctcatccgcccagccctgtcccctgcagcctggcccctgccccctggtgcctggactccgggccaggccaagccagttcccagggttccctggttgcgagggcagggccagcagcagggcagggcgagcagcaacagtgggaggcgcctcccatccagcatcctcacaggtaaagagcagccctgcggggcagcttcctttttctcctcatggcctcctctgctcagctgggggaagggggcaggggagtctccacgcgtggcaggagctgggccccgggtcttgcctgccctggtttcccagagctgttgttccaccagaactgctcccatggtgccatggcaaccaggctgccagggaacccaggtggcgacagagcccaggcgccttgagccgagcctgcacggtgaagagccacagaggtggggaagacagggaaggagtcgggcgggaaggaa

SEQ ID NO: 2217 - DNA, 1100 bp, artificial
  synthetic oligo
gcagcatgatttaaaccagtgaaaaaaatgagcacagcttctacaccctacattaagaggatggttaagtccatcgtggtatatcagttgccactaaaaatgatggttatgaagaatatgcaatgacatgggaaatgctcaaatggaaaaatcaagaacaaaaattgtatgtgtaaaatcatttcaactacatgaaaaaaatgcagagaacaagggcaaatacaccagatgctcagagtggctgcctctgggtgctgtaattatgtgtaatgtttttctcctctacttttcctagtttttctaaatttcctaatttaaaaatgcattgaaagtataattttttaaacgctactaagaaattaaattggttaagtagcctgagagtactgggaacaaaatactgtgaggcggggggcataagaatcagtgcacatgtccaccagggcttgctgggaaagctctattcttcaccggccacagcctctgaaggcccaggcccacagaacaccccctgctcccttccctgcaaagcaggacctagctcaggaagccaaaggaggaggatcttggaggccagcctattacgaatcacaatcttatgggttgtactgataaacagaaggccctacactggggcccacattttaggggccactctccatcaggcaaaaggtctgtaatgccatcaggacccataaggatctttggccctgtcccttctaggctgcacttcaagcaccaaggacctcagaatttcctgcctaaatttcttgggcttactttcaggaattgcatggtcttattacccaggtccatctgttaggaccaaggagcggcctaaggggaaggggagatagacagggcttggaggtgttggctggggtatccacatatctcaaggctccatatgaactatgggagggaagagaagtgtggagggccaagggcttcaactggtaacttgcttgggccctagaaatgtagaggcaggcaagtctatagagccttaggcctcagggtttgtagaaggccctagccttcacagatctgggttcaaatccattcatttgctgtgcaacccatggatgaatccattctcc

SEQ ID NO: 2218 - DNA, 3500 bp, artificial
  synthetic oligo
ccagcctgctgcctcaccacgggggagttgcagagagctgtctcccggcagatttcctgaggcagaaggtttccccacccccagcccagcctccaagagacactccactggttgtggcacatggtaggaccagctgagcagtgagaggagggggaagcctgtccattcgctacaggacttcagacttgctctgtagtgtggctggattaaacatagaaccatcaaatctgagctggaggggtacttcaagatcatccaaggcagaccttgccatttaaaaagatacgggggaactgatggcctaagagagaaagagactcagtcaaggtcacaaagccaatctgcagcagagctggaaggggaactcaggtctcccaactcccagctcagtgttccttcgaatacggcagaaaagaaataagggagcctttagggcagccttgggagtctgcacgcccttgactctctcagcctgatacatgtaacccaatcagctcaccatggtatctacacagaaaaagtggacccagcccatgtcccaccaacccaagagatagtgccaaggtgtcccaaatagacacacagaccccagtgcaggaactggaaccgatccagcagaggggcaatctagacttcccttcccggtagggctctttaaatgggtgttgtttttcttgaagggtggagagggggtggactttgaggaactagccaagggcttggcctccatctttgctcccccatctttgctccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcgggaccgccccggccgccggcccgccccccgcccctgcccccacccggctcgcccggcccgcccccgcgcgccccacctgcggctgccacccgcacccgcagctggactggccccaaggcaccggcgcccggccagggccagccccatgacagcccgcaagagatctctccattccacccgtccctgggtcctcacttaacggagcctaaagaagccctccttcccagagtccgcccgtccctcgggttcgccaggttggggatcttcatccaaagccatcccgggaggaacccccatcccaggcagtccccaggtcccgacaacccgtggactccccatgccctaggtctgccaatcccaagcagtgtcagattccccttcctagccagcccctgtgtcttctacctcaggcgacctccctccagcccccatcatgggcagtcgtccctgagtctcccatcctggccagtcccttgactgtctgcagctgccctcatcccaggcatcccttgggactcccaaaggatgcgcacacacacactcatgtacaacatcgcaggcatctcccactccagccagcccttacactctccattcaaaccagtgcccagatctcctaccccagccaaccccagaatcccccatctcagccagtccccgggtcctctaaccaaggcagtccaggatctctcaactcaacaagccctgggactccacatcacagccagtcttgggatcaaggctccattcattcaaccaaccctcatttcctgctctcttttagaaatgctctccccattcactccatcatccccatccactgaaactgtacccatccttcaagacttaactcaaatgccaccttactgaagccaaccctgatttcctcagccagaagtgcaagttgctgctctctctctctctctctctcccctcttgacctcctgctgcactccctatcttgtggaatttgtggaacaagtggaacttgctttacagcacattcgtctgtgttcttgttttatgtcctctgccagacggagctccttaaagacagaaacgtgtcttaatttatctttgtgagcaggttgggttagaggagaaaacatgagttttacagtcagacaaaactggatttaaattccatcttctctcttaatttcaatttccctatcaataacagctac

SEQ ID NO: 2219 - DNA, 2050 bp, artificial
  synthetic oligo
gaggcaggggaatcgcttgaacccgggaggcggaggttgcagtgagccgagatcgtgccactgcactccagcctggcaacagagcaagattctgtctcaaaaaagaaaagaaaaaaaaaagagagagagatctgattggtcctggaatgagggatcagttctgcacctttccggtgggataagacctactcccaggcataagagagtattgccctctagtggtaataataatgataatgatgataatgataatgataatgataatgataatgataataacaactagtggatgtggtccttgcttgggagatcaaccatacccgtttgcccaagattgttttagcacttgaaagacccacatctcaagaaacctctgagtctcaggcaagcctactccttgatggtgttcaatgcactcgtatacacatgatctcattacatggctcctaaccctcgatgccaggaatcaggattcagtctgcacagatctgtagagctttagagatccagcccattttccagatgaggaaacaaagcccaagaggagggaaaaaatttccttcgtcagcattacattacaaattaatggcagaaccagaatcagcatctaggtgtccaggtccacagccccggccactgttgcccctggctggcatgccctcagctactctgtcagtttgtctaggtcccatgtcctccagactcgctaaactactcaccccttaatcctttcagaaaacttccccctctgaaagcctgaaacactcatttgacacttagcatgtgctataggtaccgttttttatcccttaaatgtatagttcaaaaaaaagaaagctcctcagctccccacaagcccaacccccagagatactaacaaggagagcggcctctggtcagaagagtctcaggagtggccctagttggtccagggccccgaggaaagtgcatttggcactgcagagcaagaaaggaagcagagggaggcttttgcaatcaccaggtgggatggatttgagagccaagagctgaggagaggtgaaaaggcatccttgcagcctcaagacaaaaggagaaagtgagagccttctttgccccagggatgccgccagggaatgggtcctgctttttctgctgccaaaattgctgtgcccttctccgttcccctggtccctgacaaggacccccaaaatcagctcttgcctttcccctccactgagacaaatttgcaaactcccacatctctgtggaaacggcagagagcaggagagaagaaaaaaggagaaaaaaatccacccacatgccaacaaactggaaaaaaaataacccaggccttgtcgcactcagctgttggcttgctgctccctcccactgtggcggctgctcctgcctcctggacatggacccaatgctgtgcagttccccttcccatctggagctggcttttgtcaatgccccttgtccctacccccaccccagctctgggagagagagtcctggagtccaggaggaggaaagctggaagggaggaccggcagagccacccagggctgtggctgaccacagactctgtgcccatcaccgtctcccaaactatggaggggaacttcctcccctcccagggaaataagttaaggagatggggcactgcccacaggctggccccaccaggccacttctgtctcagaggctgtcccctgcgtcttctgtcctccctcccccaagcccttccccttggctgcctctctctaccattttcaagctctgttttcagtctaactccttctattttcatctttttgtgccctcgcctttcttcaccttctgctccagttctgggcaccatatttaaacaaagcaaaacaaaacaaaatggagtgtgttgctaggaaaggagggatgtagaaatcatcactattaggaaaacggagatgttttgcccgtagaaaggaggatatggactcagaggagcatggaaggatagaaacacaaggagctttttggataaccttattttacagatgaggtgatcgaggcccagagagggaag

SEQ ID NO: 2220 - DNA, 1050 bp, artificial
  synthetic oligo
ggctatgggagagatagtgctgtataatagtctctagctcaaagtatatattacattccaaaaaatagtataccattgtttcaagatgttatttcccaactggcatcaaaaccaagtttcagtaagccatttcacccttcaagtaggccagctactctaacatgatgtggtatgtggtaagaccagttaattccataggcatgagtccattgctgcacttactttgctgcgaaccagaagcaaagccgtgcagaagagtctacagatggtagtgctggcacaaggattatgggcagagtagggaaaactatatccagaaaatacatctgtttctgtgagactgaatctctgtccccctccatgatggaagacttccaatgtaatcaacctgtcaccaggtggttggctggtccccatagggaatagtgccatatcagggactcaattttggttgatgctgttggcagattaggcactcagcaaccatgccacccttggtaaggggaagtccatgttgttgagcccaggcatagtctctgtccctgcccatggcctatttctttatgggcccattgagcaaatactggagtggctggtgaaagaggctgatgcacatcaacagaccacatcattttgtcccctggattcataacagtctcctatgcaatgtatgccttttggtgggcattcacataggactcaaatatcttcagtctgtccccactcagagaaggctggtcacatttctcttcctcagacttccttgtcgccaatctttcaatcttgttcttttcaagtccctaactacatgtcagtgtagatctatacttctgactatctcttactccacacatagtggacaactaaacatactgttcagtgttctgcccactggagaggatcttccttcaccattgtcatccagtcacccctgagtacagttgtagtgctgcatctgtctacttttggatggtaccagtataacatgcagacccatatataaggtaggcttcagttttccttcctcagtcaagtggtcataggaacact

SEQ ID NO: 2221 - DNA, 1150 bp, artificial
  synthetic oligo
ttgtgttgtcttttacatttggatttttaaaactttattatttttaatgtcatgggtacataataagtgtctatatttatggggtacatgagatattttcatacaggcatgcggtgtgtaataatcacatcatggaaaatggagtatccatcctctcaacacgttcatcctttgtgttgcaaacaaacctattgtacccttttagttatttttaaatgtacaaataagttattattgactataatcaccctgttgtgctatctaatactagatcttattctaaatttggttttaagcttgtctgcatattatgttcttattttcctttttgctttgctgtgtcttcataatagtctctttcttttcaacttgctcctacttaaatgggaagccctgtttagtctgctattttctctgatataaggtggatgcattctcccacactccacacttagtttatctgaaaacttttgcccccttctcaggactacattttaagatatgtgtctagctatttatctcactgtagcttatgggttcacagggtgttggtagtagtagcggtggtgaatacttacttggagggtctgggccctaccattttcatatttatggcatgcggtcttcttatcttgttttgttgtagtttggtgtgcattttgctggcctttaccacttttcctttattaggcattggaggagggaaattctgagatttgactttataccatcatatctttctctggcagctgatagagtaacttatacttccaatctagacttctcttttgttctctaggtccatataactaacagggtcattaatatctcttatgtggtggcgatcactgtctttggcctacccaacaaacatatcctgtcccaccttctctattcagatatttcacaggcatcccctgacttcgtggacaaaattagaagtgatctaaataaatgataatgttctcaatcttcttatttatttatttatttagttagttagtttttgcttgtttcttttgttttgttttgtgttttgagatcgtgtttcactcctgttgcccagctggagtgcagtggcacgatcttggctaactgcaacctgtgcctcctgggttcaagagattctcctgcctcagcctcccgagta

SEQ ID NO: 2222 - DNA, 1100 bp, artificial
  synthetic oligo
gctcttctctcagtgagggtgggggtggagccagagtttttccactgtgtgtggctggagtacaatggtcattatctaagttttctgcgttgccaggctgcccctttcttggtcctttatctggagaaaggctatttttttggtctgcatctgttggtgtttgtgggttgcaggcttctccagtatccagtctagtatgtatgagacaaaaagaaaaccaaagaactcaccaatgtgttgtttcttgggtcccaatgtccgtagttgttctgccttctctccacctttcaaagtcttatgtttgattgattgattggttgatgaaacggggtctcactttgttgcccaggctggagtggggtggtgagatcatgactcactgcagccttgacctcctcgggctccagtgatcctcccacctcagcctcctgagtagctgggactacaggcgtgtgccaccatgcccagctaatttttgtattttttgtagacacggggtttctccttgttgcccagtctggtctcgaactcctgggctccagcgatccacctgcctcagtctctcaaagtgctgggatttacaggcatgagccacttcatctggccgtgtttgttttatatataatatctagagtttttagttatacttagtgggcaaaataggaaaaagtatgtctactccatcttctcagaagtggaaggccaaggtagttagtagcagcagagatggtgaaaagatgtcagagtctgcaaatatttttaggtaaatccaacaggatttgctttgtgaaaggaaaatatcatggggccccaaaatcactaagctaaagggaaaaataaagctgggaactgctgagggcaaacctgcctccaattctattcaaagtcacccgcctgctcactgagataaatgcatatctgattgcctcctttggagaggctcatcagaaactcaaaagaatgcaaccatttgtctcttatctacctacaacctggaaccccccttccctggtccagttgtgccgcctttccagaccgaaccagtgttcatcttacatatgttgattgatgtctcatgtctccctaaaatgtataaaacc

SEQ ID NO: 2223 - DNA, 1050 bp, artificial
  synthetic oligo
cttttgcatcgctcggaaactggcagcgtttccttgcagccccccctcaaactgatgagagctccctagtctccccaaatgttcaggtacctcacagtatatcctaaaactgacagtaatagcctcgcagcccccaaaacttacaggaatcttaacgcttccccaactgacaggaacctcctcacgccccaaacctgacaagaacgtcttcagtccagaatcctacagggacctcctcatgctttgggctgcaaggactccacgcccgcggagctcagccccagcgacacgccggcagccgggctagctccgggactgcgaagcgcctcagcggaggctcgtccggtagttccggcccctacggcgacgcgcgtcgaattctgggatagtccccgtaccgccgggaacctcgctcgccttcccctcgagccccccgctgggtcgcgcggcgccagccgctcaacggtgcttcagagcagcctcctccacaacattcccctcggcccggccgttcgggcctactggagaccgcggcttgggcctagtctggcggccgcccggcgaacgggcaagtggcgtcgtcgctgggccggcaggagatactcgcgagcaaaccaacggggaaagagatgaaccggccgccacgtccgaggcacacggcccgaaaagtcgctgggagaagcccagtggcggtggtaggcaattcggagtagtcaataaagtttattcaaaacaatgaggaagttgaggcggagaggggaggagaaatacgggataaacagctaccatgttgagagtggcggcgctacccagacaaccaaggcgaccgccatcttatgagggctggactcgcgaggtgagcgcggcggaggcggggaaccgcgagccgccggctcccgggtgacgtcatcgggggggcggggcgccaccttgagaaaggagggcggttctcagccacctttggacccgctcgtctctttaaggtgcccaatcgccgctgaagaccttgagcccagaggcggagaagccgccatcttaggcgaggcagac

SEQ ID NO: 2224 - DNA, 1050 bp, artificial
  synthetic oligo
cactttgagaagtaaacatggtggctggacatacagactatcctctgaataaactttacaagcaggatggttaagtacaaccattttctcctctacaagaaggaaaatgaaaaggacaggtttgtgtgttttttggaaaggaaggccctttttatatagtaggctctttgttaagaagggaatttctgagctttacctcaagttaattatttctggggaggaaaagtacctcagacaaggatgaaaatagcactattatatgatttagcaaaattatgaaataatgcaaaagccctggatagaaaactagccagtatttacagtcaaagtgactataatctgaaccaaacatgtaagtcatgggaaaaaataattttaataaaaccccacagtgatgagaataacattgttttctccatttctgcacaagctcacttttttctgtatttttaaatgtacacatgttatatatacataatgtatacataacatatatgataacccggttactgcagtcagcatggagacagcagtacactattcaccatcttcaaactttagaagactacttttctttccagcaaaaacctgaaaagattgtaaatattacaaggcactgcaagagtctgcaggcaaacaagaatgatgaattatatgtggaatagaggtggtggccaaaggcagaacataggatgtagagcagtcattaatacatgtaattgtacatgtcagccatggagcttttttcatcctggggtacactgtttaaaatgattgtgactagagaagaaggggtcctaaaatctgcagtattttcactttataggttgtatggctcggtgtaattacacaaagccaactttttataatgaaacacaggcagttttaaagaattagggattttaggagcattgtttttatacatatggaaaacagtgcaatgcaagcatttgcattacactaatgtcctaaaatcactttaaactgcaaaccaatactgtacaagaaatttgaagaatctgtacttaacatttggaaagactcatacaa

SEQ ID NO: 2225 - DNA, 1050 bp, artificial
  synthetic oligo
cctgtgaagaggcctgctgaatgaaggacatctgctcagggttttgaagctgtccttccactgccctctgagatataatgctagttgcctgggcctgagtttttagctgctggtgtccaaaactgacatctgcttgggatggagtcgctgaaagctggacattaaataaaggctcagtagaatgtgtctgtgtatctaaggttggtattaaatacatcctttgttccaatgttgaagaagaactaccttggggttgtgttaaataggcttgttgctcaaaagtctgtgctacaaatggtggtacagagtataacttctgatgtgcagagtttgtctgtcatgtgtactcacttgctatcaggagggcttattgtatatacctgctgggttatgaaggttgcatgttcagttatctggatagtgtaagcagtttgtcctaaataagatacatgctcaagagacagtgtctgataagcaagctgttccataggttgcataaggtaagctgcctggattgcatatgctgcctggtctggaaaaggtgactgaagcagaggttgcactagataagcagactgcacgtgagtctttgccaaatatgagggctgtactgcagctgggactggataagaagtctgcacagaataggctggctgtgatctcggtggttgtacagtgtaaagaggatgctccaggactggcagtgaataaacaggctgtttatgtagtggagcctgaattgagtaagttggctgtgatgagtaagaagtttgttgctggggacatatcacaaagggcagctgctcaggagccttcaatgggaaggatgataattccgcaggtggccctggaagtgtgttgaacagaataagaaggctattccaggggctgaatcacactttcaataccaccctttggctgttgctgacttgcaagagcttcagactcttggagaacataatcctgctgaacatttttctgtggagatgccaaaatcttaggttgtaaaattaatgattgttgctgaatacaagcttggaaacaatactc

SEQ ID NO: 2226 - DNA, 1100 bp, artificial
  synthetic oligo
tcccttgtctctgagcctgatgatgtaggtaatgaataaagaacaacacttggaaatgttagcccttcaatctgcttagatgttaattcttttgagcagtacctctttgatagttgaatacttgttaaaaaaaaaaaaagctattgagtagagtgacttttatgacctttagaaatttgaaaatcaaacaagtcggctccccatccaaatacaggtccttctcaatttagaccttttattgacatatgtgctcttctgtttgggacaatctggtctgtaactcagcacaaatgccactgtaggcagaaaggggagcgggcaattctagctaatcaccaaggtatgacagggaacattcccttcctacccactggtttccactgactctcaagtgacatttgcaatgttcctactcatcaaacagaaattttgatttatattaactatttgtagtttggttttacattgttccaggaaatcatccttccaataatctaattcatttttttctagaggctccggtgccaataaattacaaaaaatttaactggaatcatttttaaaccccaaaatcccacaggagtgggggtaggaggttagtttcatggccctactatctgttggtctctttcctaccacacaggatggtaactccttcagtcaacaagatggagctgaaatgaacctcaaagtttgtagttagctgaccactgcaaccatgggtagagttgtgactgtttctggaacttaatttctgacccggtgccctctttttaaccaggttattggggcggggaggtaaacaatgtccatcattcttgatgttcatttcccttaacccaagtgataccacagtttggggatcttaggtaatgtccaggcatgggtgtaagtgggagtggagtaaggatatctgcttctagttatttagatcctggcagtttgtgctgagccctctgcccacatgggtcctttccagtgctgtggtcctctccaatgtctctgcgacatggggcacagaatttttcccgaagtcccaatagatattgggccatctacctagacattccacacagctcttcctctcttgagtcttcccc

SEQ ID NO: 2227 - DNA, 1650 bp, artificial
  synthetic oligo
gctgccttgcaatcctccctctttttctcgcgagtgctccctctcccattagcctcagcagacagaggagaagggggttggagaggttgaggggcacaagggacagagagaggagatggggacagaggttgaaaggactggacataaggccaagggacgtggggaggaggaggggtttgagggaacccaaagggccgaggtaagcgagcctgttccgaggtggggcttagagggctcgagaacaagaacccgctcccagtaccaggcccgtggcccgggctcccatgctctctcagtcgctcactcaccaggccgaggctgcgagccctccaggtggtaagagaagcgcagggcccggtggtgctgtggactgggaccgcagggcaagacccggtggcctggagcagcgcccaggctggtgtccgagggtccgacaaactggggatccagtgggccgccaagagccgaacctgagcccctgcgcgccagcagtccgggttccgaggctccagggtccgagtcggcacaggccggcggagcggcgcccggcgggttcgtggccgggtgttcgggctccgaaggcccggcgccccccggggctcggtggccatgcatggtccgggcctgggcgcggggcccgagctccccgcttggctccagctcctggggcggaggcgcgggcggaggaggcccggcgcccggcggagcagcggcctcaggatcggggggcgggactgcgggctcagccccactgcagagactcaagcccccagcccgggcccgggccagcagccgtggcagcggtggcagtagcagcagcagcagccgcggccaccgccgctgccgtgccaggcatcgccggccccggccccggccccgcgcggggagtgggctcggcggggccgggggcccgctggggagcgctgtctatgcggctgcggttgggcgagggttggagggctacgctcggcggggactctccggtggacggcgagccacttccgtggccccggggcgagaagtcggtcggatccaagtgcggggtctcttctttctccccgaatgggaatagatctgggctctcctggctggttgggaagcgttcttcctcccgccgcagccgaggccgggggcggaggagaggggaggggagaggaggggagggaagagagaacggcggtggccgggggcgcgcgtgtgcgctgcgcttgggctgcggggctcgccttcagccagtagtcccagacgatgctccagccgcgggggcaggagaacggcctgggccgggctccaccgtcctccccagcttcagcctgggtctcggcggcggcgggcgggaaggagccctgggaaggggggtggggaggcgggagcctcgcagaggcagccgcagccacagcggcactgggacccagttaccggggccccgccccctcgcccgggatttgcgcctgaccacgccccctcgctcggggccgcctcacttctcgctgctaccgctctcaaggccctcctgccccttaaaaaattccccctcagcctgctttccccacaggcaagtctccgggctcaaccccctccccccatatctgcccttccatcccatctcaggtcttcccccctctgcttgccgttcactctcttttccaa

SEQ ID NO: 2228 - DNA, 1100 bp, artificial
  synthetic oligo
tgagatggcagagaaagggggacagccaggtttggagaagacagggaagattagaaagaaggagacaagaggagggaggaggcccagaggaggtaaaaatatctgtttaacccactgtcactctttgatgtgagcctctgcctcaggttctgccagtgtctcctgacctacagcctggcttcctacaacctcccttcatagcagtctccagagggatctttgtaacacccagatatgactgtgtctctcctcggcttacaacccttcatggctcctcattgctttcaggataaagcccaattcctcatcctggcattcaactctgaccactcaactctatttcctccaacttccattcctttcctccacactcttgtttagcctttcagactcagcgtgggtgtgtctacctcctccaggaagtccttcttgagctctgaggctgggcaaattcccccactctggttttctctagctccctgggcagctttctgtccagcaatgatcccctcctgtgttcactatccatatctgggtctgtcctctcccaagatgaggagctccccaagggaagagtctgttgctgattcctcttccttgttggggatatacatgcctttcaccctggcagggtctttttggtggctggtgctccctggcccctctcagcctcagctgcacttacctatcaggccacgggctgaggggctgaggcctgagccattggccacgtagaaccccaggtggggtagttgcagggtactgggatgcctgtagcggtgtcggaggactaggaactcaaggtagggcccaaggcggagggtaaggcgggctgcagcagccacatagagctccagctggggcctcttcagcagggcaggttggtcccaggacaggcgcaaggtaccctcgcctcgcaaagatatagaactgcggctgatggtgatagtataggcccggggtttgtctgtagtgactgtgatgatctggaagtaggtgcgagtctggtccttgtggcccggccttggtggtgcgccaagcagcttcccactcacatgcagccctggagggaggggagtgtgggcctggagcgggggctt

SEQ ID NO: 2229 - DNA, 1150 bp, artificial
  synthetic oligo
gcagccatctgtgaacttaggtgggcggtccgccgcactgagggcggggctttggcagctgagcagttccgctcagggttccgtcgcttaaaaagtggcaaaatgccgtttgtaagtaaccggacgcaccacttggacttctgagtagaggaaaaacgcattgagactcagctgtccgagcggaaggagcgggagcccaactggaaactcctctcgccattcattgcccctaggcttccgctttgcttccttcagcgtccacccagttcctcctcccgccaatgagagctgaggaagttgaagcccccgcccgacgtgcgtcaggcgctttagtggtacgcacgagaacgcctgcgcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagtgagcgctctggattccaggatccctacatactttttctttcccgctaacttttgtcccctgtcccatgtaattttactttcccagtttcctattcttagagtcctgtccttagacccaggtcccttccctcttaaacttccatttcccaccctagctagatcccctaattgcactccatctcctgtcttcagcaaactttagctccttctcgaaaccccatatctagtcagattcccactcattctccggccccaaactcagtcccctgaatttcctccttccatacgctgtccatctccccgccgccaagtcaaacccccgaattcttcatccctgccccaagctcagatcctctaattcccaccccatctttgaccccagctcagtctaatttcctctttttcacatttccacctcagaaccccagtaccccttatctattcccatctctcctcccagcggaaagtccctaattcccacctcatttcccaccccaagcttagatgtcctcttatttcttcaccctcttatctcc

SEQ ID NO: 2230 - DNA, 1050 bp, artificial
  synthetic oligo
tttccctattgaattaaccttccattgctgccataacaatttgtcacaaactccatagctttaaattgaagaaggaattaatgaaatcaactataacctaatagtagtaatagatattttaaaatcctcttaaagttgctgcaaaatatgaccccccccgaccttacagtcaagttaaaagagaatattaacagcctgtcttctctctgtggacagtggaccttatctatactccccagctccacattcctcaaagtttattacaggcccagcgagttcctgcacggctgcagggtcgcaagaccgataagtttaggttgcaagacatgtttctctcaagatgtaagaaatgttgtaaatgctgcctttgtttcttgcttctgtaacttgcttcctgcctcacgtagttcccgccttaagatgtttaaaagtaggaaaagccctttgttcagggctcagactttctgtacatttgtccggcaggaatctcagatcccattcagagacttcaaagaggtctcacccatcccattggcacttacaaaaggtcccacaaacccagggaggaaatggtaccattttctccagacacatctgtgaaatctgtctgtgaggtcttcactcatttacagtttgtcattttaattccgcttagcacagaacaactaagagtagtacggtctgcagaaaaaaaaggaaatgaaaaaatgacataaatcttgcccctacactcaatgccctttttctggaccaaggatagactagaagcccagctgtcctggcatagtcctccatgctgatgtgtggcttacccaggcacagtgtgcatgacttttcccaggccatggctgggctgtttgggtctccatgtttcccacctccaggagagcaggagaaatggaattaggtctcaaggcctcacccagacaagactcatggaggctataaccagggctggcctcctacaagttatcctgcagagaaaagctatatcttccctgatcaaggaagcgtggaagagggtgatatggatctagaattgatgccatg

SEQ ID NO: 2231 - DNA, 1500 bp, artificial
  synthetic oligo
actaaaaatacaaaaattagctgggagtggtagcgcatgcctgtagtcccagctacttgggaggccaaggcaggagaatcacttgaacctgggaggtggaggttgcagtgagccgagattgtgccactgcattccaacctgggtgacagagtgagacttcatctaaacaaacaccttgaagaaccacaattcctactcaagctgctttttagagacagagaaattgagaaacctctcttttcctactcaaggtatttccttaagggaagcccagctggatggaatatataggagtcagctcaacaagatgttctaatttacttacaaaaagctacgtctgatcagggcccccttcctatgcttccttttcatgtactatttcccacattaaactgctaagtaatataaaagtaaagacaacaggaatcatgcacacagcttactgtctacgttagtgtgagtttatactccactagcttcatcaacatgtttactaacacaggaatctcttgcctaggaaaataaacgttgcaaagaactttactgttgtttcagcaactgcctgaaagatctatcaactcctcaataaaaggtgtcaaatgacgtttttcaatcccaaaactctttgaagccttagtctaaaaatccttgtcttgttggctccatcaatcctaaatcattatgattcctacccaattctaacaaaactgtccctgactttaaaagacccactttacaccagatttcaaactcagaataaatgtgcctaaagccagtacacatctgacatactagtggctcttttgaggtagtgctcttccttacagtgctatgcaaataatgtcagagctctcttatgaacaggttatttggctgctatttggggagtgcagtttatgatgagcatagtcaccactgctgtacatcatgtcacagtagactgagcctagatcctaccatcaacatctatggagatttctgaactataacactgcctgaatgacctacagttatattcatgtaaatctgttactattccagagagttaaatgtgcaataacacaacctaaaaatagtaaacaggtgtgtatttatttagtctgcattagaatttagttaaactcattgcaagcatgacagaaaacacagaaccaaataaaaattgattaatcaaagcatgtataaaaattggccaaggtgggaggatcacttgagcccaggaattcaagaccagcctgagcaacatagtgagaccactgcctaaaaaaataaatcaatcaattgcccaggtgtggtgtccacacctgtagtaccagccactcggggggactgtgtcttgaggattgcttgagcccaggagatcgaggttgcagtgaggtatggtcatgccactgccctccagcctgggtgtctgagtgacatcctgtctgaagaaaagcatttataaatatagatatgaaaataatttagttctttcacaaaaggtctttctatgtcctc

SEQ ID NO: 2232 - DNA, 1300 bp, artificial
  synthetic oligo
gtccctgactatgaaagtcttttgtgaaaagtctgaactttggccgggcacagtggctcaggcctgtaatcccagcactttgcgaggccaaggcaggcagatcacctgaggtcaggagttcgagaccagcctgaaaaatatggtgaaaccccgcctctactaaaaatacaaagaaaaacaaaaacaaaaacaaaaaactgggcatcgtggtgtgatcctatagtcccagctactcgggaggctgagagaggagaattgcttgaacctgggaggcggaggttgcagtgagccgaaatcatgccactgcaccccagcctgggtgacagagcgagactccgtaaaataaataaataaataaataaataaataaataaataaataaaagtctgaactttatttcaagatcattgggaagcttttgaaggattttgatcaagagtgcttagcccagtgggattgaaaaaaaagagaatgaactttctctgtttattgagagaacaggaaaacatgtgaaacaactaaaggacaatttaggactatatatgataaacaatacagttgcatggcaatgtagtgtcattgaaaaattcctgggcaaggtgataaaatacctcattgatttgcatctatggcttattttcttatcctcttctttttaccgctcttcctggtggctgattttaacaactgtttaaaacagatctgtgtgttttcttactattgttttgcttatcatgggcttctacttcttcttaaaatctgttttacctctttttcctcttcatcctgtgtagcctgaaaatcattttccgtgacacaaagtgaggaacaacgtatcttatgttattcaccaactttgtacaattgaccttgtgtagtttttctatccattctttgcttatcttgctctgaatataataaccaaatcatgtcctttctgtcacccttattaatatttttgcaagccatgatgaattatgggccttattccttacttcccctttaaactgtagcaggagtagaagctccagtttcttttcacagtaaaagggagaggaaaatatctggaacagaaatgaaggaaggaagagtataggaagatttgtagaaaagaaagggatatttaccacatagtttttgtgaaggtcaaatgagtcaatacatgtcaagtgtttgaaattaagccttgcacacggtacctgttcaacagatgttgactgttattatttgaatggtaatgatggtaatggttttatcagtcagggttccagaagaaaacagatgccattgagtaattggg

SEQ ID NO: 2233 - DNA, 1050 bp, artificial
  synthetic oligo
atcccccttgcgtatgtacccactgaatgtaaaataaaattggaaaaaaataaacattttccaattataaaaagaaatgcgctcagactattctgttctacttaataaggactgtcctcgagagaaactatttacccgagtctaaccaacttgggaaaaaggggatacccctaataatctttttgtctcaccaaagaggagagaaaaaaaatgaccaagaagtacatgtcagggtcacaaactagggatacaggctcactaaaagactgagatctaaatataggactatagaatgtagtccccacccacctccaatttaccattacatcaaaagtgcttgtgtatattgatagggagatgcaatggaaagaactgcatatctcagaccttatttacaaatcatgccatataaccttacattggatcaatgtagaatatttttatgcagctatgccaaaatggcccactaaaactgtaaaatcactttaaaattcacatatatcttcaacagaagattatagggggggtctttattaatttatgtgttgtttgaatttttgtatgtattactgttaatgttagagcaattaaatatttttaaggtctgtcaaaactggatttacataaaacaataatattcatttagtatgtgtcatactccaggtacttttgtaagtgctttacatatattattaatccattaatcttaacaacactatgaggcagatttaccactatttcctatgtaaaatatgttggaaaatcaaggcacaaagagattagtcaacctgctcaaatttatttagctagtaaataatatcaaagtagttatgagtagaggcttctcacattaatatgaatgattatatcgtgtgtgtgtgtgtgtgtgtgtgtgtgtgtgtgtgtgtgtatagagttagaaataattattagaaattgaatttagaattttgtggtacttggatcagataccaaaggatcacattgtgatttaatatcctctgaatgtgtagcacctcaatctccttgagtgtcaatatatatccaatc

SEQ ID NO: 2234 - DNA, 1050 bp, artificial
  synthetic oligo
aaatcccacccttggggctgtggcatgatgtggggaggttgcactggggaaggtgtgaggggctacagggtggcgggtgtgtgggtgtgtaggtctgcattccagccactgcagatttctctatgaatctgcataggcctcctaagaaggagactggcgcgtgcctagagaaaaagcaggaagataagaatgcaggaagatctggactgcatccttaggggtggcattgtgactctgattgtcagaggtctccgtttttaacgtttaactcccatcacatctcaactttttcctgtcttcacctgtgcttccaaatgtcctcaggcacatatatgtgtccctactcatactcactcacaagcgtctgcccaggcacctccactcatacctgggtcctgttgtgcaggcaactctcagagggcagggttcttcagcttcccggttccatcttgttcatcttcctcatcccttgttgtctggctgcccaatatttgctggcggagggtgcgggatgtgttgggggtggagacagcagggagcagggcagcctcctggcccaacaggcctctgtgcacatgcagtgcagacctgggcataaggggctgacactttctcctggctggttggtggctcttcctctgtgaagccacagaaggtcactcgggttgccacctgtccatctgggacattctgcattcttgttcgctgtcatcctcattgctcacgttgattcttagtatacttttggagtttttcttccttcacttttttcttcttcactgtctttacttctcgtccacttctggtttggggaggtcaggattcgcctggaaggcagggtccggttggcaagcgaacatatttagggagaacacgccttcttttcctcaggaaattagaaagacctcagttgactcctgccagatgtaatcggggtgcccctctcctttctgccctctctccctagtgccataggtggctgattacctcctttccctggtgtccttttcctctccgtttttcctctctcctcccatttctggggtccta

SEQ ID NO: 2235 - DNA, 1100 bp, artificial
  synthetic oligo
attaggggcccacttaaggaagcaatctgacccttagtggagctggtgtacaggaatacccctccatcggatctcgcagactcttcagagccagcaggcaggaaggattaagtccactcaaactgagaccacagccgcccctcctcccaagtgctctgtccctgggagattagagttctgtctgtaaacccctggctggagttgctaaaattcctgctgggtggccctgcccagtgaggagggatacatctgggtcccacttaaagaaacagtctggccatgatctgccacagcagctgtgctgcgctgtggggaattctgcccagtcttcctagcactggcagggaaaaaactgctgactagagccacagtaatggtggtcgcccctcccctcgggaacttggtcatcttaggcagactccagcctgctgtgctgggcagcgaggattccaagctaatggatcttcgtttgcggggttctgtgttattgggacacactgagagaggctgcttggctccctggcttcagctccctttccgcgggagtgaatggatctcctgcctcactggagttccaggagccactggggtatgcaaaaactcctgcagctcagtgcctacccgagcagctgccagcccctgcagctgccatgggtctgcacagctttgtgcttgggacccaaggccttggtgctgtgggctcacaggagaatatcctgatctgcgggttgcaaaaatctgtgggaaaggcgttcttcgggcgagtagcacaatccctcccccgcctcccttggctaagggagggaagtccctttgccccgtgcagttcctaggtgaaccatcaccccaccctgcttttccttgctctttatgggtcgcaccaactgcctagtcagtcccaatgagaggatctggctaccacagctggaaatgcagaattcattcactgtttacgatcatctagctaggagctgcagaccagaggtgtttctactcggccatattgttccctccctctatcctactccttttactcttgtaaaatggtggcttttgataaaaagttttaattttaatgtactccagttttacagtgtttt

SEQ ID NO: 2236 - DNA, 1400 bp, artificial
  synthetic oligo
tgattgaggaatttggaaacagactttagtagtgtctgtgaagggatatttttgagcctttttaggcctatggtgaaataggaaatacattcacataaaaactaaacagagctgtctgagaaatttctttatgatgggtgatttcatctcacagatttgaaccttatttttgattgaacagtttgtaaacagtttttatgtagaaactgcaaatggacatttggagcacttcgaggcctatggtgaaaaaggaaatatcatcaaacaaaaactagactgaaactttctgagaaacttctttgttattcgtgcgttcatctcccatagttaaaatttacttttgatagagcagtttgaaaacagtctttttgtagaatctgcaaatggatgttttgagggctttgaggcctatggtgaaaaaggaaatatctacacataaaaattagacagaaactttctgagaaacttctttgtgatgtgcgctttcatctcaaagagttgaaactttcttctcgttgagcagtttggaaccagtctttttgtagaattggcagagggatatttctgagcggtttgaggcctacggtgaaaaaggaaatatcttcacataaaaactaggcagaagcattctgcgaaatttcttggtgatgtgtgcattcatctgacagagtttaacctttcttttgattgagcagtttggaaacagtcttttagtagtatctaccaagggatatttttgagccatttgaggctgatgctgaaataggaaatatcttcacataaaaactagacagaagctttctgagaaacttctttgtgatgtgtgccttcttctcgcagatttgaacgtttctttttattgagcagtttggaaactgtgtttttgtagaatctgaaaagggatatttggagcgctttgaggcctatggtgaaaaaggaaatatcttcacataaaaactagacagaagcattctgagaaacttcattgtgatgtgtgcattcatctcacagaattgaacctttcttttgagtgagcagtttggaaacattccttttgtagaatctgcaatgtgatatttgtgagcggtttgaggcctatggtgaaaaaggaaatatcttcacatgaaaactagacagaggcattgtgagaaacttctctgtgatgcatgcattcatctcacagagttgaaactttcttttgattgggcaggttggaaacagtccttttgtagaatttacaaaaggttatttgtgaggcctatggtgaaacaggaaatatcttcacatgaaaaccagagagaagctttctgagaaaccacttagtgatgagtgccttcatctcacagagttgaacctttcttttgattgagcagtttggaaatagtgttcttgtagaatct

SEQ ID NO: 2237 - DNA, 1200 bp, artificial
  synthetic oligo
aacattccttttcatagagcagatttgaaacactctttttgtagaatttgcaagtggatatttggaaggctttgaggccttcgttggaaaagggacatcttcacaaaaactggacagaagcattctcagaaacttctttctgatgtgtgcattcaactcacagagttgaacctttcttttgaaagagcagttttgaaacactctttttgtagaatctgcaggtggacatttgtagcagtttgaggcctatggtgaaaaaggcaatatcttcacatgaaaactagccagaagcattctaagaaacctctttgtgatgtgtgccttcaactcacagagttgaaccatttttttgatagagcagttttgaaccactgtttttgtagaatcagcaagtggacattttgagccctttttgtcctgtggtgaaaaaggaaatatcttcaagttaaaactacacagaagcatcctcagaaacttctttgtggtgtttgctttcaattcacagatttgaactttccttctcatacagcagatttgaaatactctttctctaaaatttgcaaatggatatctggactgctttgaggccttcgttgaaaaagggaaatcttcacaaaaactagacagaagcattctcagggacttctttgtgatgtgtgcattcaactcacagaattgaactgttcttttaatagagcagttttgaaacactcttttcgtagaatctgcaagtggacacttggagtgctttgaggcctacggtgaaaaaggaaatatctccatataaaaacaacacagaagcactctgaggaacttctttgtgatgtatgcattcaactcatataattgaaccgctattttgacagagcagttttgaaaccctctttttgtagaatctgaaactggatatttggagtgctttggggccaatgctgaaaaaggaaatatcgtcacataaaaactacacagaagcattctcagaaacaacattgtgatgtgtacattcaactcacagagatgaacccatcttttgatagagcagtctggaaaccctccttttgtggaatcagcaactggacatttggagtgctttgaggcatatgatgaaaaaggaaatatcttcacaaaaaaactacacagaagcactctcagaaactgctttgtgttggttgctttcaactcacagagctgaacattcct

SEQ ID NO: 2238 - DNA, 5200 bp, artificial
  synthetic oligo
tccatttgcagattctacaaaaagagtgattccaatctgctctatcaataggattgttcaactccatgagttgaatgccatcctcacaaagtagtttctgagaatgcttctatctagttttcatgtgaagatatttccttttccaccacaggcctcaaagccctccaaacgtccacttgcagattctcgaaaaagagtgtttcatagctgctctttcaaaaggaaagttcaactctgggagttgaatacagacatcacaaagtagtttccgagaatgcttctgtttagtttttatgtgaaaatgatcccgtttccagtgaattcttcaaagaggtccacttatccccttgcagattccaaagaaagaggatttcaaaactgctccatcaaaaggattgttcaactctgtgagttgaatgcagtcatcgcagaaaactttctgagaatgcttctgtctaggtttgatgtgaagatatagacatttcaagcgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcaggtatgggaagctgatcccgtttccaaagaaatcctcagagaggtccaaatatccccttgcagattctacaaaaagtgtgtttggaaactgctccatcataacgaatgttcagctccctgagttaaactcaatcgtcacaaagaattttctgagagtgctaccgtctagtttttatatgaagttctttcctttactaccacaggcctcaaagcggtccaaatctgcacttgcagattccacaaaaagagtgtttgcaaactgctctatcaagaggaatgttcaactctgggagttgaatgcaatcatcaccgagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactctgcgaggtgaatgcaaacatcccaaggaagtttctgagaatgcttccgtttagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctcccgtctttctgtgaagataaaggaaaaggctttcaggccttttccaccacaggcctgaaagcgctccaaatgtccacttgcagattctgccaaaagaatatttcgaaactgctctatgagaagcaatgttaaactctgtggctcgaacacaaacatcacaaagcagtttctgagaatgcttcagtttagtttttctgtggaaatattcccgtttccaaagaaatcttcaaagaggtccaacatatccacttacagattctacaaaaagacagtttcaaaactgctccatcaaaaggagggttcaaccgtgtgacttgaatgcaatcatcactcagaagtttctgagaatgcttctctttagtttttacgtgaacatatacccgtttcgaacgaaggccacccagtggtccaaatatccacttgcagattctacagaaagagtgtttcaaacctaaactctgaaaggaaggttcatctctgtgagttaaatgcattcatcatgaagaactttctcagagtgtttgtgtttagttatgggaaattattcccgtttccaacgagatcctcagagaggtccaaatatccacctgcagattctaccaaaagtgtatttggaaactgctccatcaaaaggcatgttcagctctgtgagttaaactccatcatcacaaagaatactctgagaatgcttccgtttgctttttatatgaagttccttcctatactaccgtaggcctcaaagcagtccaaatctccatttgcagattctacaaaaagagtgattccaatctgctctatcaataggattgttcaactccatgagttgaatgccatcctcacaaagtagtttctgagaatgcttctatctagttttcatgtgaagatatttccttttccaccacaggcctcaaagccctccaaacgtccacttgcagattctcgaaaaagagtgtttcatagctgctctttcaaaaggaaagttcaactctgggagttgaatacagacatcacaaagtagtttccgagaatgcttctgtttagtttttatgtgaagatgatcccgtttccagtgaaatcttcaaagaggtccacttatccccttgcagattccaaagaaagagggtttcaaaactgctccatcaaaaggattgttcaactctgtgagttgaatgcagtcatcgcagaaatctttctgagaatgcttctgtctaggtttgatgtgaagatatagacgtttcaaacgaaggctacaaactggtcaaaatatacacttgcagattctactacaagggtgttgcaaacctgaactatcaaaggaaggttcaacactgtgagttgaatacaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctccctgagttaaactcaatcgtcacaaagaattttctgagagtgctaccgtctagtttttatatgaagttctttcctttactaccacaggcctcaaagcggtccaaatctccacttgcagattctacaaaaagagtgtttgcaaactgctctatcaaaaggagtgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatagttcaaaactgctctatgaaaagcaatgttaaactctgtggctcgaacacaaacatcacaaagcagtttctgagaatgcttcagtttagtttttctgtggaaatattcccgtttccaaagaaatcttcaaagaggtccacgcatccacttacagattctacaaaaagacagtttcaaaactgctcaatcaaaaggagggttcaactgtgtgacttgaatgcaatcatcactcagaagtttctgagaacgcttctctttagtttttacgtgaacatatacccgtttcgaacgaaggccagccagtggtccaaatatccacttgcagattctacagaaagagtgtttcgaacctgaactctcaaaggcaggttcatctctgcgagttcaatgcattcatcatgaagaactttctcagcgtgtttgtgtttagttatgggaaattattcccgtttccaacgaaatcctcagagaggtccaaatatccacctgcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaaactttctgagaatgcttctgtctaggtttgatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctctctgagttaaactccatcgtcacaaagaattttctgagggtgctaccgtctagtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactct

SEQ ID NO: 2239 - DNA, 2900 bp, artificial
  synthetic oligo
agattctacagaaagagtgtttcgaacctgaactctcaaaggcaggttcatctctgcgagttcaatgcattcatcatgaagaactttctcagcgtgtttgtgtttagttatgggaaattattcccgtttccaacgaaatcctcagagaggtccaaatatccacctgcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaaactttctgagaatgcttctgtctaggtttgatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctctctgagttaaactccatcgtcacaaagaattttctgagggtgctaccgtctagtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgtggctcgaacacaaacatcacaaagcagtttctgagaatgcttcagtttagtttttctgtggaaatattcccgtttccaaagaaatcttcaaagaggtccacgcatccacttacagattctacaaaaagacagtttcaaaactgctcaatcaaaaggagggttcaactgtgtgacttgaatgcaatcatcactcagaagtttatgagaacgcttctctttagtttttacgtgaacatatacccgtttcgaacgaaggccagccagtggtccaaatatccacttgcagattctacagaaagagtgtttcgaacctgaactctcaaaggcaggttcatctctgcgagttcaatgcattcatcatgaagaactttctcagagtgtttgtgtttagttatgggaaattattcccgtttccaacgaaatcctcagagaggtccaaatatccacctgcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatgtgctctatcattaggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaatctttctgagaatgcttctgtctaggtttgatgtgaagatatagacgtttcaaacgaaggctacaaagtggtcaaaatat

SEQ ID NO: 2240 - DNA, 3400 bp, artificial
  synthetic oligo
tctcagagtgtttgtgtttagttatgggaaattattcccgtttccaacgaaatcctcagagaggtccaaatatccacctgcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatgtgctctatcattaggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaatctttctgagaatgcttctgtctaggtttgatgtgaagatatagacgtttcaaacgaaggctacaaactggtcaaaatatacacttgcagattctactacaagggtgttgcaaacctgaactatcaaaggaaggttcaacactgtgagttgaatacaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctccctgagttaaactcaatcgtcacaaagaattttctgagagtgctaccgtctagtttttatatgaagttctttcctttactaccacaggcctcaaagcggtccaaatctccacttgcagattctacaaaaagagtgtttgcaaactgcactatcaaaaggagtgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatagttcaaaactgctctatgaaaagcaatgttaaactctgtggctcgaacacaaacatcacaaagcagtttctgagaatgcttcagtttagtttttctgtggaaatattcccgtttccaaagaaatcttcaaagaggtccacgcatccacttacagattctacaaaaagacagtttcaaaactgctcaatcaaaaggagggttcaactgtgtgacttgaatgcaatcatcactcagaagtttctgagaacgcttctctttagtttttacgtgaacatatacccgtttcgaacgaaggccagccagtggtccaaatatccacttgcagattctacagaaagagtgtttcgaacctgaactctcaaaggcaggttcatctctgcgagttcaatgcattcatcatgaagaactttctcagcgtgtttgtgtttagttatgggaaattattcccgtttccaacgaaatcctcagagaggtccaaatatccacctgcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaaactttctgagaatgcttctgtctaggtttgatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctctctgagttaaactccatcgtcacaaagaattttctgagggtgctaccgtctagtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcgaagctgcgctatcaaagggaaagttcaactctgtgaggtgaatgcaa

SEQ ID NO: 2241 - DNA, 6450 bp, artificial
  synthetic oligo
acatatacccgtttcgaacgaaggccacccagtggtccaaatatccacttgcagattctacagaaagagtgtttcgaacctgaactctcaaaggcaggttcatctctgcgagttaaatgaattcatcatgaagaactttctcagagtgtttgtgtttagttatgggaaattactccttttcccaacgaaatcctcagagaggtccaaatatccacctgcagattctaccaaaagtgtatttggaaactgctccatcaaaaggcatgttcagctctgtgagcgaaactccatcatcacaaaggatattctgagaatgcttccgtttgccttttatatgaagttccttcctatactaccataggcctcaaagcagtccaaatctccatttgcagattctacaaaaagagtgattccaatctgctttatcaataggattgttcaactccatgagttgaatgccatcctcacaaagtcgtttctgagaatgcttctatctagtttttatgtgaagatatttccttttccaccacaggcctcaaagctctccaaacgtccacttgcagattctcgaaaaagagtgtttcctagctgctctttcaaaaggaaagttcaactctgggagttgaatacaaacatcacaaagtagtttccgagaatgcttctgtttagttcttatgtgaagatgatcccgtttccagggaaatcttcaaagaggtccacatatccccttgcagattccaaagaaagagggtttcaaaactgctccatcaaaaggattgtacaactctgtgagttgaatgcagtcatcgcagaaaactttctgagaatgcttctgtctaggtttgatgtgaagatatagacgtttcaaacgaaggctacaaagtggtcaaaatatacacttgcagattgtactaaaagggtgttgcaaacctgaactatcaaaggaaggttcaactctgtgggttgaatacaaacatcgcagagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctcccagagttaaactccatcgtcacagagagatttctgagagtgctaccgtctagtttttatatgaagttgtttcctttactaacacaggcctcaaagcggtccaaatctccacttgcagattctacaaaaagagtgtttccaaaccgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagaaaaagtgtgtcaaagctgcgctatcaaagggaaagttcaactctgtgaggagagtgaaaacatcccaaagaagtttctgagaatgcttcctttcagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcaccacgaagtttctgacaatgcttctccctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgcggctcgaacacaaacatcacaaagcagtttctgagaatgcttcagtttagtttttctgtggaaatattcccgtttccaaagaaatcctcaaagaggtccacgtatccacttacagatcctacaaaaagacagtttcaaaactgctccatcaaaaggagggttcaactgtgtgacttgaaagcaatcatcactcagaagtttctgagaatgcttctctttagtttttacgtgaacatatacccgtttcgaacgaaggccacccagtggtccaaatatccacttgcagattctagagaaagagtgtttcgaacatgaactctcaaaggcaggatcatctctgcgagttaaatgtattcgtcatgaagaactttctcagcgtgtttgtgtttagttatgggaaattactcccgtttccaacgaaatcctctgagatgtccaaatatccacctgcagattctaccaaaagtgtatttggaaactgctccatcaacaggcatgttcagctctgtgagtgaaactccatcatcacaaagaatattctgagaatgcttccgtttgccttttatatgaagttccttcctatacgaccgtaggcctcaaagcagtccaaatctccatttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaagggaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaaactttctgagaatgcttctgtctaggtttgatgtgaagatatagacgtttcaaaagaaggctacaaagtggtcaaaatatacacttgcagaatgtactacaagggtgttgcaaacctgaactatcaaagaaaagttcaactctgtgggttgaatacaaacatcgcagagaatgttctgagtttgcttccgttcagttatgggaagttgatcccgtttcctacgaaatcctcagagaggaccaaatatccccttgaagattctacaaaacgtgtgtttggaaactgctccatcataacgaatgttcagctccctgagttaaactccaacgtcacaaagagttttctgagagtgctaccgtccagtttttatatgaagttctttcctttactaccacaagcctcaaagcggtccaaatctccacttgcagattctacaaaaagagtgtttgcaaaccgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagagaaatgtgtcgaagctgcgctatcaaagggaaagttcaactctgtgaggtgaatgcaaacatcccaaagaagtttctgagaatgcttccgttcagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctccctcgtctttctgtgaagataaaagaaaaggctttcaggccttttccaccacaggcctgaaagtgctccaaatgtccacttgcagattctgccaaaagaatatttcaaaactgctctatgaaaagcaatgttaaactctgcggctcgaacacaaacatcacaaagcagtttctgagaatgcttcagtttagtttttctgtggaaatattcccgtttccaaagaaatcttcaaagaggtccacgtatccacttacagaatctacaaaaagacagtttcaaaactgctcaatcaaaaggagggttcaactgtgtgacttgaatgcaatcatcactcagaagtttctgagaatgcttctctttagtttttacgtgaacatatacccgtttcgaacgaaggccacccagtggtccaaatatccacttgcagattctacagaaagagtgtttcgaacctgaactctcaaaggcaggttcatctctgcgagttaaatgcattcatcatgaagaactttctcagagtgtttgtgtttagttatgggaaattattcccgtttccaacgaaatcctcagagaggtccaaatgtccacctgcagattctaccaaaagtgtatttggaaactgctccatcaaaaggcatgttcagctctgtgagtgaaactccatcatcacaaagaatattctgagaatgcttccgtttgccttttatatgaagttccttcctatacgaccgtaggcctcaaagcagtccaaatctccatttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaagggaagttcaactctgggagttgaatacaaacatcacaaagtagtttccgagaatgcttctgtttagttcttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcagaaacctttctgagaatgattctgtctaggtttgatgtgaagatatagacgtttcaaacgaagactacaaagtggtcaaaatatacacttgcagattgtactacaagggtgttgcaaacctgaactatcaaaggaaggttcaactctgtgggttgaatacaaacatcgcagagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctccctgagttaaactccatcgtcacagagagatttctgagagtgctaccgtctagtttttatatgaagttgtttcctttactaccacaggcctcaaagcggtccaaatctccacttgcagattctacaaaaagagtgtttccaaaccgctctatcaaaaggaatgttcaactctgggagttgaatgcaatcatcacagagcagtttctgagaatgcttctatgtcgtttttaggagaagatatttccttttccaacacagtcctccaagcccgctaaatatccacttgcacattgtagaaaaatgtgtcgaagctgcgctatcaaagggaaagttcaactctgtgaggtgaatgtaaacatcccaaagaagtttttgagaatgcttcctttcagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcaccacgaagtttctgacaatgcttctccctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgcggctcgaacacaaacatcacaaagcagtttctgagaatgcttcagtttagtttttctgtggaaatattcccgtttccaaagaaatcctcaaagaggtccacgtatccacttacagattctacaaaaagacagtttcaaaactgctcaatcaaaaggagggttcaactgtgtgacttgaaagcaatcatcactcagaagtttctgagaatgcttctctttagtttttacgtgaacatatacccgtttcgaacgaaggccacccagtggtccaaatacccacttgcagattctagagaaagagtgtttcgaacatgaactctcaaaggcaggttcatctctgcgagttaaatgtattcgtcatgaagaactttctcagagtgtttgtgtttagttatgggaaattactcccgtttccaacgaaatcctctgagaggtccaaatatccacctgcagattctaccaaaagtgtatttggaaactgctccatcaacaggcatgttcagctctgtgagt

SEQ ID NO: 2242 - DNA, 1400 bp, artificial
  synthetic oligo
attgttcaactctgtgagttgaatgcagtcatcgcagaaaactttctgagaatgcttctgtctaggtttgatgtgaagatatagacgtttcaaatgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagattctgcaaaacgtgtgtttggaaactgctccatcataacgaatgttcagctctctgagttaaactccatcgtcacaaagaattttctgagagtgctaccgtctagtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagttcctgagaatgcttctatgtcgtttttaggagaagatatttccttttccaccatagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgcggctcgaacaccaacatcacaacgcagtttctgagaatgcttcagtttagtttttctgtggaaatattcccctttccaaagaaatcttcaaagaggtccacgtatccacttacagattctacaaaaagacagtttcaaaactgctcaaacaaaaggcgggttcaactgtgtgacttgaatgcaatcatcactcagaagtttctgagaatgcttctctttagtttttacgtgaacatatacccgtttcgaacgaaggccacccagtggtccaaatatccacttgcagattctacagaaagagtgtttcgaaccttaactctcaaaggcaggttcatctctgcgagttaaat

SEQ ID NO: 2243 - DNA, 2050 bp, artificial
  synthetic oligo
ctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatccttctatgtcgtttttaggagaagatatttccttttccaacacagtcctccaagcccgctaaatatccacttgcgcattgtagaaaaagtgtgtcgaagctgcgctatcaaagggaaagttcaactctgtgaggtgaatgcaaacatcccaaagaagtttctgagaatgcttccgtttagctttcaggtgaagattatcccgtttccaacgaaatcttcaaagaggtccaaatatccccttgcggatcccacagaaagagtgttttgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgtggctcgaacaccaacatcacaaagcagtttctgagaatgcttcagtttagtttttctgtggaaatattcccgtttccaaggaaatcttccaagaggtccacgtatccacttacagattctacaaaaagacagtttcaaaactgctcaatcaaaaggcgggttcaactgtgtgacttgaatgcaatcatcactcagaagtttctgagaatgcttctctttagtttttacgtgaacatatacccgtttcgaacgaaggccagccagtggtccaaatatccacttgcagattctacagaaagagtgtttcgaacctgaactctcaaaggcaggttcatctctgcgagttaaatgcattcatcatgaagaactttctcagagtgtttgtgtttagttatgggaaattattcccgtttccaacgaaatcctccgacaggtccaaatatccacctgcagattctaccaaaagtgtatttggaaactgctccatcaaaaggcatgttcagctctgtgagtgaaactccatcatcacaaagaatattctgagaatgcgtccgtttgccttttatatgaagttccttcctatactaccgtaggcctcaaagcagtccaaatctccctttgcagattctacaaaaagagtgattccaatctgctctatcaataggattgttcaactccatgagttgaatgccatcctcacaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagttcttatgtgaagatgatcccgtttccagtgaaatcttgaaagaggtccacatatccccttgcagattccaaagaaagagggtttcaaaactgctccatcaaaaggattactcaactctatgagttgtatgcagtcatcgcagaaaactttctgagaatgcttctgtctaggtttgatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagattctgcaaaacgtgtgtttgggaactgctccatcataacgaatgttcagctctctgagttaaactccatcgtcacaaagttttttctgagagtgctaccgtctagtttttatatgaag

SEQ ID NO: 2244 - DNA, 4250 bp, artificial
  synthetic oligo
tcccaaagaagtttctgagaatgcttccgtttagctttcaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgcgaaaagaatatttcaaaactgctctatgaaaagcaatgttaaactctgtggctcgaacaccaacatcacaaagcagtttctgagaatacttcagtttagtttttctgtggaaatattcccgtttccaaagaaatcttccaagaggtccacgtatccacttacagattctacaaaaagacagtttcaaaactgctcaatcaaaaggagggttcaactgtgtgacttgaaagcaatcatcactcagaagattctgagaatgcttctctttagtttttacgtgaacatatacccgtttcgaacgaaggccagccagtggtccaaatatccacttgcagattctacagaaagagtgtttcgaacctgaactctcaaaggcaggttcatctctgcgagttcaatgcattcatcatgaagaactttctcagagtgtttgtgtttagttatgggaaattattcccgtttccaacgaaatcctcagagaggtccaaatatccaccggcagattctaccaaaagtgtatttggaaactgctccatcaaaaggcatgttcagctctgtgagtgaaactccatcatgacaaagaatattctgagaatgcttccgtttgccttttatatgaagttccttcctatactaccgtaggcctcaaagcagtccaaatctccatttgcagattctacaaaaagagtgattccaatctgctctatcaataggattgttcaactccatgagttgaatgccatcgtcacaaagtagtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagtttttatgtgaagatgatcccgtttccagtgaaatcttcaaagaggtccacatatgcccttgcagattccaaagaaagagggtttcaaaactgctccagcgaaaggattgttcaactctgtgagttgaatgcagtcatcgcagaaaactttctgagaatgcttctgtctaggtttgatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaatgttctgagtttgcttccgttcagttatgggacgttgatcccgtttccaacgaaatcctcagagaggtccgaatatccccttgcagattctacaaaacgtgtgtttggaaactgctccatcataacgaatgttcagctctctgagttaaactccatcgtcacaaagaattttctgagagtgctaccgtctggtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatgcttctatgtggtttttaggagaagatatttccttttccaccacagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgcttaggttttaggtgaagattatcccgtttccaacgaaatcttcaaagaggtccaaatatccccttgcggatcccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatatccgcttgcagattctgcgaaaagaatattacaaaactgctctatgaaaagcaatgttaaactctgtggctcgaacacaaacatcacaaagcagtttctgagaatacttcagtttagtttttctgtggaaatattcccgtttccaaagaaatcttcaaagaggtccacgtatccacttacagattctacaaaaagacagtttcaaaactgctcaatcaaaaggagggttcaactgtgtgacttgaaagcaatcatcactcagaagattctgagaatgcttctctttagtttttacgtgaacatatacccgtttcgaacgaaggccacccagtggtccaaatatccacttgcagattctacagaaagagtgtttcgaacctgaactctcaaaggcaggttcatctctgcgagttcaatgcattcatcatgaagaactttctcagagtgtttgtgtttagttatgggaaattattcccgtttccaacgaaatcctcagagaggtccaaatatccaccggcagattctaccaaaagtgtatttggaaactgctccatcaaaaggcatgttcagctctgtgagtgaaactccatcatcacaaagaatattctgagaatgcttccgtttgccttttatatgaagttccttcctatactaccgtaggcctcaaagcagtccaaatctccatttgcagattctacaaaaagagtgattccaatctgctctatcaataggattgttcaactccatgagttgaatgccatcctcacaaagtagtttctgagaatgcttctatctagtttttatgtgaagatatttccttttccaccacaggcctcaaagccctccaaacgtccacttgcagattctcgaaaaagagtgtttcatagctactctttcaaaaggaaagttcaactctgggagttgaatacaaacctcacaaagtagtttccgagaatgcttctgtttagtttttatgtgaagatgatcccatttccagtgaaatcttcaaagaagtccacatatccccttgcagattccaaagaaagagggtttcaagactgctccatcaaaaggattgctcaaatctgtgagttgaatgcagtcatcgcagaaaacgttctgagaatgattctgtctaggtttgatgtgaagatatagacgtttcaaacgaaggctacaaagtggtcaaaatattcacttgcagattctactacaagggtgttgccaacctgaactatcaaaggaaggttcaactctgtgagttgaatagaaacatcacaaagaatgttctgagtttgcttccgttcagttatgggaagttgatcccttttccaacgaaatcctcagagaggtccaaatatccccttgcagattctacaaaacgtgtgtttggaaactgctccatcataacgaatgttcagctctctgagttaaactccatcgtcacaaagaattttctgagagtgctaccgtctagtttttatatgaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctcagaatgcttctatgtggtttttaggagaagatatttccctttccaccacagtcctccaagcccgctaaatatccacttgcacattgtagaaaaagtgtgtcgaagctgcgctatcaaagggaaagttcaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaactgctgtttcaa

SEQ ID NO: 2245 - DNA, 2450 bp, artificial
  synthetic oligo
tgggaagttgatcccgtttccaacgaaatctgcagagaggtccaaatatccccttgcagattctacaaaacgtgtgtttggaaactgctccatcataacgaatgttcagctctctgagttaaactccatcgtcacaaagaattttctgagagtgctaccgtctagtttttataggaagttctttcctttactaccacaggcctcaaagcggtccaaatctccacttgcagattctacaaaaagagtgtttgcaaactgctctatcaaaaggaatgttcaactctgggagttgaatgcaatcatcacagagcagtttctgagaatgcttctatgtggtttttaggagaagatatttccttttccaccacattcctccaagcccgctaaaaatccacttgcacattgtagaaaaagtgtgtcaaagctgcgctatcaaagggaaagtacaactctgtgaggtgaatgcaaacatcccaaagaagtttctgagaatgcttccgtttagcttttaggtgaagattatcccgtttccaacgaaatcttcaaagaggtccaaatatccccttgcggatcccacagaaagagtgtttcgaaacttctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgcgaaaagaatatttcaaaactgctctatgagaagcaatgttaaactctgtggctcgaacacaaacatcacaaagcagtttctgagaatgcttcagtttagtttttctgtggaaatattcccgtttccaaagaaatcttcaaacaggtccacgtatccacttacagattctacaaaaagacagtttcaaaactgctcaatcaaaaggagggttcaaccgtgtgacttgaatgcaatcatcactcagaagtttctgagaatgcttctctttagtttttacgtgaacatatacccgtttcgaacgaaggccacccagtggtccaaatatccacttgcagattctacagaaagggtgtttcgaacctgaacactcaaagacaggttcatctctgcgagttcaatgcattcatcatgaagaactttctcagagtgtttgtgtttagttatgggaaattattcccgtttccaacgaaatcctcagagaggtccaaatattctcctgcagattctaacaaaagtgtatttggaaactgctccatcaaaaggcatgttcagctctgtgagtgaaactaaatcatcacaaagaatattctgagaatgcttccgtttgccttttatatgaagttccttcctgtactaccgtaggcctcaaagcagtccaaatctccatttgcagattctacaaaaagagtgattccaatctgctctatcaataggattgttcaactccatgagttgaatgccatcctcacaaagtcgtttctgagaatgcttctgtctagcttttatgtgaagatatttccttttccaccacaggcctcaaagccctccaaacgtccacttgcagattctcgaaaaagagtgtttcatagctactctttcaaaaggaaagttcaactctgggagttgaatacaaacatcacatagtagtttccgagaatgcttctgtttagtttttatgtgaagatgatcccatttccagtgaaatcttcaaagaggtccacatatccccttgcagattccaaagaaagagggtttcaagactgctccatcaaaaggattgctcaaatctgtgagttgaatgcagtcatcgcagaaaacgttctgagaatgcttctgtctaggtttgatgtgaagatatagacgtttcaaacgaaggctacaaagtggtcaaaatatacacttgcagattctactacaagggtgttgccaacctgaactatcaaaggaaggttcaactctgtgagttgaatagaaacatcacaaagaatgttctgagtttgcttccgttcagttatgggaagttgatcccgtttccaacgaaatcctcagagaggtccaaatatccccttgcagattctacaaaacgtgtgtttggaaactgctccatcataacgaatgttcagctctctgagttaaactccatcgtcacaaagaattttctgagagtgctaccgtctagtttttatatgaagttctttcctttactaccacaggcctcaaagcggtccaaatctccacttgcagattctacaaaaagagtgtttgcaaactgctctatcaagaggaatgttcaactctgggagttgaatgcaatcatcacagagcagtttctgagaatgcttctatgtggtttttaggagaagatatttccttttccaccacagtcctccaagcccgctaaatatcc

SEQ ID NO: 2246 - DNA, 1100 bp, artificial
  synthetic oligo
aaaggaaagttcaactctgggagttgaatacaaacatcacaaagtagtttccgagaatgcttctgtttagtttttatgtgaagatgatcccgtttccagtgaaatcttcaaagaggtccacatatccccttgcagattccaaagaaagagggtttcaaaactgctccatcaaaaggattgttcaactctgtgagttgaatgcagtcatcgcacaaaactttctgagaatgcttctgtctaagtttgatgtgaagatatagacgtttcaaacgaaggctacaaagtggtcaaaatatacacttgcagattccactacaacggtgttgaaacctgaactatcaaaggaaggttcaactctgtgagttgaatacaaacatcacaaagaatgttctgagtttgcttccgttcagttatgggaagttgatcccgtttccaacgaaatcctcagagaggtccaaatatccccttgcagatactacaaaacgtgtgtttggaaactgctccatcataacgaatgttcagctctctgagttaaactccatcgtcacaaagaattttctgagagtgctaccgtctggtttttatatgaagttctttcctttactaccacaggcctcaaagcggtccaaatctccacttgcagattctacaaaaagagtgtttgcaaactgctctatcaaaaggaatgttcaactctgggagtggaatgcaatcatgacagagcagtttctgagaatgcttctatgtcgtttttaggagaagatatttccttttccaacacagtcctccaagcccgctaaatatccacttgcacattgtagaaaaagtgtgtcaaagctgcgctatcaaagggaaagttcaactctgtgaggtgaatgcaaacatcccaaagaagtttctgagaatgcttccgtttagcttttaggtgaagattatcccgtttccaacgaaatccttcaaagaggtccaaatatcccattgcggatcccacagaaagagtgtttcgaaactgctgtttcaaaaggaatcttcaactctgtgagttgaatgcaatcatcacaaagaagtttctgacaatgcttctctctggtctttctgtg

SEQ ID NO: 2247 - DNA, 2500 bp, artificial
  synthetic oligo
tgcagattctacaaaaagagtgattccaatctgctctatcaataggattgttcaactccatgagttgaatgccatcctcgcaaagtcgtttctgagaatgcttctatctagtttttatgtgaagatatttccttttccaccacaggcctcaaagccctccaaacgtccacttgcagattctcgaaaaagagtgtttcatagctgctctttcaaaaggaaagttcaactctgggagttgaatacaaacatcacaaagtagtttccgagaatgcttctgtttagtttttatgtgaagatgatcccgtttccagtgaaatcttcaaggagttccacataccacttgcagattccaaagaaagagggtttcaaaactgctccatcaaaaggattgttccaatctgtgagttgaatgcagtcatcacagaaaactttctgagaatgcttctgtctaggtttcatgtgaagatatagacgtttcaaacgaaggctacaaagtggtcaaaatatacacttgcagattctactacaagggtgttgcaaacctgaactatcaaaggaaggttcaactctgtgagttgaatacaaacatcacaaagaattttctgagtttgcttccgttcagttatgggaagttgatcccatttccaacgaaatcctcagagaggtccaaatatccctttgcagattctacaaaatgtgtgtttggaaactgctccatcataacgaatgttcagctctctgagttaaactctatcgtcacaaagaattttctgagagtgctaccgtctagtttttatatgaagttctttcctttactaccacaggcctcaaagcagtccaaatctccacttgcagattctacaaaaagagtgtttgcaaactgctctatcaaaaggaatgttcaactctgggggttgaacgcaatcatcacagagcagtttctgagaatgcttctatgtcgtttttaggagaagatatttccttttccaacacagtcctccaaacccgctaaatatccacttgcacattgttgaaaaagtgtgtcaaagctgcactatcaaaggcaaagttcaactctgtgaggtgaatgcaaacatcccaaagaagtttctgagaatgcttccgtttagcttttaggtgagattatcccgtttccaacgaaatcttcaaagagttccaaatatccccttgtggatcccacagaaagagtgtttcgaaactgctgtttcaaaaggaatcttcaactctgtgagttgaatgcaatcatcacaaagaagtttctggcaatgcttctctctcgtctttatgtgaagataaaggaaaaggctttcagaccttttccaccacaggcctgaaagcgctccaaatgtccacttgcagattctgcgaacagaatgtttcaaaactgctctatgaaaagcaatgttaaactctgtggctcgaacacaaacatcacaaatcagtttctgagaatgcttcagtttagtttttctgtggagatattcccatttccaaagaaatcttcaaagaggtccacatatccacttacagattctacaaaaagacagattcaaaactgctcaatcaaaaggagggttcaactgtgtgacttgaatgcaatcatcacacagaagtttctgagaatgcttctccttagtttttacgtgaacatatacccgtttcgaacgaaggccacccagtggttcaaatatccacttgcagattttacagaaagagtctttcaaacctgaactctcaaaggaaggttcatcactgtgagttaaatgcattcatcatgaagaactttctcagaatgtttgtgtttagtcatgggaagtctttcccatttccaacgaaatcctcagagaggtccaaatatccacttgcagattctactaaaagtgtatttggaaactgctccatcaaaaggcatgttcagctctgtgagttaaactccatcatcacaaagaaaattctgagaatgcttccgtttgctttttatatgaagttccttcctatactaccgtaggcctcaaagcagtccaaatctccatttacagattctacaaaaagagtgtttccaatctgctctatcaataggattgttcaactccgtgagttgaatgccatcctcacaaagtagtttctgagaatgcttctatctagtttttatgttttttatgtgaagatatttccttttccaccacaggcctcatagccctcctaatgtccacttgcagattctcgaaaaagactctttcatagctgctctttcaaaaggaaagctcaactctcggagttgaatacaaacatcacaaagtagtttccgagaatgcttctgtttagtttttatgtgaagatgatcccttttccaatgaaatgttcaacgaggtacacgtatgcccttgcagattccaaagaaagtgggtttcaaaactcctccatcaaaaggattgttcaactctgagagttgaatgcagtcatcgcagaaaactttgtg

SEQ ID NO: 2248 - DNA, 1950 bp, artificial
  synthetic oligo
gattacacacatcacaaagagatttctgagaatgcttctgtctaatttttatgtgaagatatttcgtttttcatcataggcctgaaagcgttacaaatgtccacttgcagatcctacaaaaagagtttttcaaaactgttctatcgaaggaaaggtttaactctgtgagttgaatgcacacatcacaaagaagtttgtgagaatgcttctgtccagtttttatgaagatatcccttttccaacgaatgcctcaaagcggtccaaatatcctcttgcaaattctacaaaaagagtgtttccaaactgctctatgaaaaggaatgttcagctctgtgagatgaatgcaaacatcacaaagaagtttctgagaacacttctgcgtagtttttatgtgaagatatttcctttttcaccataggcctcaaagcgcaccaaatttccagttgcagattctgcaaaaagagggtttctaaactgctctatcaaaagagagtttcaattgtaggagttgaacgcatacatcacagaaaagttcctgagaatgcttctgtgttgtttttacatgaagataattccttttcctccataggcctcaaaacgttccgaaagctcacttgcagattcaacaaaaagagtgtttcacaacagctttatcaaaagaaggcttcaactctgtgagttgaatgcacacatcacaaagaagttcctgagaatgcttctgccaattttttgtgaagatatcccttttccagcgaaggtctcaaagcgttccaaatacccacttgcaaattaaaaagagtgtttcaaaactgctctatgaaaaggaacgttcaactctgttagctgaaaataaacatcacaaagaagtttctgagaatgcttctgtgtagtcttaatgcgaagacatatttcctttttcacctcaggccttgaagtgctccaaatgtccacttgcagattctacaaaaagagtgtctcaaaactgctctatcaaaagaatcgttcaactctgtgagttcaatacacacatcacaaagaggtttctgagaatgcttctgtctagtttttatatgaagatatttcctttttcaccataggcctcaaagtgctacaaaatgtccatttgcagattgtacaaaaaagagtgtttcaaaactgctctatcaagggaaaggttcaagtcattgagttcaatgcacacatcagaaaggagattctgagaatgcttctgtcttgtttttgtgaaggtatcccttttccaacgaaggcctgaaagccgtccaaatatccacttgcaaattctacaaaaagagtgattcgaaattgctctatgaaaaggaatgttcatctttgtgagttaaaagcaaacatcagggggaggagccaagatggccaaataggaaaagctctggtctacagctcccagcgtgagcgacacagaagggtgatttctgcatttccaactgaggtaccgggttcatctcactagggagtgccagacagtgggtgcaggtcagtgggtgcgcgcaccgtgcgcgagccgaagtagggcgaggcattgcctcactcgggaagtgcaagtggtcagggagttccctttccgagtcaattaaagaggtgacagagggcacctggaaaatcgggtcactcccacccgaatactgcgcttttccgaggggcttaaaaaacggcgcaccacgagagtatatcccgcacctggctcggagtgtcctgcgcccatggagtctcggtgattgctagcacagcagtctgagatcaaacagcaaggcggcagcgaggctgtgggaggggcgcccctaatgcccaggcttgattaggtaaacaaagcagccgagaagctcgaactgggtggagcccaacacagctcaaggaggcctgcctgcctctgtaggctccacctctgggggcagggcacagacaaacaaaaag

SEQ ID NO: 2249 - DNA, 3100 bp, artificial
  synthetic oligo
aaaggaaggttcaactctgtgagctgcaaataaacatcacaaagaagtttctgagaatgcttctgtctagtgtttatgtgaagatatttcctttttcaccatagacttcaaagtgctccaaatgcccacttgcagattctacaaaaactgtttcaaaactgcactatgaaaacaacgcttcaactctgtgagttgaatgcacacatcacaaagaagtttgtgagaatgcttctgtccagtttttgtgaagatatcccacttccaacgaaggcctcaaagcggtccaatatccacttgcaaattctacaaaaagagtgtttcaaagctgctctatgaaaaggaatattcaactctgtgagtttaatgcaaacaacacaaagaagtttctgagaatgcttctgtgtagtttttaggtgaagatatttcctttctcaccataggcctcaaagctctccaaatgtccacttgcagattctacaaaattgaggtttcaaaactgctctatcaaaagagaggttcaactctgtgagttgaaagcactaaacacaaagaagtttttgagaatgcttctgtgtagtttttatgtgaagatatttcctttttcaccgtaggcctcaaagcgctccaaatgtccacttgcagattctacaaaatgagtgttccaaatatccagttgcaaattaaaaagaatgtttcaaaagtgcgctatgaaaaggaatgttcaactctgtgagttgaaaacaaacatcacaaagaagattctgagaatgcttctgtgcacttttaatgtgaagataattccttttccacctctggcctcaaagcactccaaacgtccacttgcaggttctacaaaaagagtgtttcaaaactgctctatcaaaagaaaggttcaactccatgagttgaatgcacacatcacaaagtggtttctgagaatgcttctgtctaattttttgtgaagatatttcctttttcatcataggcctcaaagtgttataaatgaccacttgcagatcctacaaaaagagtttttcaaaactgctttaccgaaagaaaggttcaactatgtgagttgaatgcacacatcacaaagaagtttgtgagaatgcttctgtgtaggttttatgtgaagatatttcctttttcaccataggtctcaaagcgctccaaatgcctacttgcagatactacaaaaagaatgtttcaaaactgctctttctaaagaacggatcaattctgtaagttgaatgcacacatcagaaagatgtttctgagaatgcttctgtccagtttttgtgaagatatcacgtttccaaggatggcctctaagtcttccaaatatccaattgcaaattatgcaaaaagagtgtttcaaaactgctctatcaaaagaaatgttcaactctgttagttgagagtaatcatcacaaagaagtttctgagaatgcttctgtgtagtttcattgtgaagatatttccactttcaccataggcctcaaagcgctccaaatgtccacttgcagctactacaaaaagagtgtttcaaaaccgctctatcaatagaaaggttcaactcggtgagttgaatgcacacatcacaaagaagttcctgagaatgcttctgtctagttttggtgaagatatcccttttccaacgaaagcctcaaagccgcccaaatatccacttgcaaattctacaaaaagagtgtttcaaaactgcactatcaaaagaaagcttcaactctgtgatttgagtgcacacatcacaaagaagtttctgagaatgcttctgtctagtttttatgtaaaaaaatttcctttttcactgtaggcttcaaagcgctccaaatgcccacttacagactcaacaaaaacagtgtttcaaaactgctgtatcaaaagaacgcttcaactctgtgagttgaatgcacacatcacaaagaagtttctgagaatgcttctgtctagtttttgtgaagatatcccgtttccaacaaaggcctcaaagccttccaaatatccacttgcaaattccacaaaaagagtgtttcaaaactgctctatgaaaaggaatgttctactccgtgagttaaaagccatcctcacaaagaaattactgagaatgcttctgtgtagtttcgttttgaagatatttctactttcaccgtaggcttcaaagcactccaaatatccatttacagaatctattaaaagaaggtttcaaaactgctctatcaaaagagagtttcaactctgtgagttgaattcacacatcctaaagaagtttctgggaatgcttctgtgtagtttttatatgaagatatttcctttttcaccattggtctcaaagccctccaaatgcccacttgcagattcaacaaaaagagtgtttcaaaactgctctttcaaaagaacggttcaattctgtgagttgaatgcacacatcagaaagaagtttctgagaatgcttctgttcagtttttgtgaagatatcccatttcaaatgaaggcctcaatgcggaccaaatatccacttgcaaaacctacaaaaagagtgtttcaaaactgctgtatgaaaaggaatgttcaactctgtgagtttaaagcaaacaacacaaagaagtttctggtaatgctggttgtgaagatatttccttttacaccacaggcctcaaagcgctccaatgtccacttgcagattctacaaatagagtgtttcaaaactgttctatcaaaaggaagcttcaactctgtgatttgagtacacacatcacaaagtagtttctgagaacgcttctatcaagtttttatgtgaagatatttcctttttcatcataggcttcaaagccctccaaatgcccacttgcagattctacaaaaacagtgtttcaaaactgctctatcataagaacgcttcaactctgtgagttgaatgcacacatcacaaagaagtttctgagaatgcttctgtcttgtttttgtgaatgtatcccgtttccaacgaaggcctcaaagccttccaaatatccacttgcaaattctacaaaaggagtgtttcaaaactgctctatgaaaaggaatgttcaactctgtgatt

SEQ ID NO: 2250 - DNA, 5800 bp, artificial
  synthetic oligo
ctctttctgtagaatttacaaatggatattcagacggctttgaggccttcattggaaaggggatgtcttcacataaaaacaaaacagaagcattctcagaagcttcgttgtgatgtgtgcattcacctcacagagttgaacctttcttttgatagagcagttttgaaacactctttctgtagaatatgaaagtggacattgggggcactttgaggcctgtggtgaaaaaggttatatcttcccgtaaaaactacacagaagtcttctcagaaacctcttcatggtgtatgctttcaactcacagagttgaacattacttttcatagagaagtttagaaacactctttttgtacaaattgcaagttgatatttggaccactttgatgccctcgttggatatgggatatcttcacattaaaactagacaaaagcattctcagaaactactttgtgatgtgtgcattgaactcacagtgttgcacctttcttttgatagagcagttctgaaactctctttttgcataatctgcaaggggacattttgttcgctttgaggcctatggtgaaaaggaaataacttcacataaagaattcacagaagcattctcagaaacttctctgtgatgtgcacattcaactcacagagttgaacctttctttagatagagtagttttgaaacgttctttttgtagaatctgcaattggacatttggagcggtttgaggcctatggtgaaaaaggaaatatcttcacataaaaactagacagaagcattctcagaaacttctttgtgatgtgtgcatttaactcacagagttgaaccattcttttcatagaggagttgtgagacactctttttgtagaatttgcaatggatattttgacctcttagaggccttcgttggaaacgggctatcttcacattaaaactagacagaagcattctcagaaactttctttgtgatttgtgcattcaactcacagagatgaacctttcttttgatagagcacttttgaagcacactttttgaaggacctgcaagtggacatttggcatgcttagaggcttatggtgaaaaaggaaatatcttcacataaaatctacacagaagtattctcagaaacttctttgtgatgtgtgcattcaattcacagtgttgaacatttcttttcatagggcagttttgaaacactctttttgtagaatttgcaagtggatatttggaccgctttgaggccttcattggaaacggtatatcttcacataaaaactagacagaagcattctcagaatcctctttgtgatgtgtgcattgaactgtaagagttgaaccttatttttgatggagcagttgtgaaacactctttttgtagaatctgcaagtggacatttgaagtgctttgcggcctatggtgaaaaaggagatatatcttcacataaaaaatacaaagaagcattctcagaaacttctttgtgatgtttgcattcaactcacagagttggaactttcttctgatagaccagttttgaaacactctttttgtggaatctgcaattggacatttggaaagctttgaggcctatagtgaaaaaggaaatatcttcacatagaaactacacagaagcattcttagaaacttctttgtgatgtgtgcattcaactcacgcatttgaaaatgcctttacatagagcagtttttaaacattctttttgtagaatttgcaagtcgatatttggaccgctttgaggccttcattggaagcggtatgtcttcacatgaaaacaatacagaagcattctcagaaacttctttttgatgtgtgcattctactcacagcgttgaacctttcttttgatagagcagttttgaagcagtctttttgtagaatatacaagaggacatttgaagcactttgaggcctgtggtgaaaaaggaaatatcttcacataaaatttacacagaagtattctcagaaactgctttgtgatgtgtgcattcaaatcacagagttgaacctttttttgatacagcagttttgaaacaatctttttgatgaatctgcaagtggacatttggagcgctttgaggcctatggtgaaaagggaaatatcttcacataaagactacacagaatccttctgagaaacttcttggtgatgtttactttcaactcacagagttgaacattcctattcatacagcagttttgaaacactctttttggagaatttgtatgttgatatttggaccgatttgaggccttctttggaaacgggatatcttcacactaaagccagatagaagcattctcagaaacttcttcgagatgtgtgcattcaagccacagaggtgaacctttctgttgatagagcagatttgaaacactctttttgtagtatctgcaagtcgacatttagagctctttgagtcctatggtgaaaaaggaaatatcttcacataaaaactacagagaagcattcccagaaacttcttggtgatgtttgctttcacgtcacagagttgaacattccttttcatcgagcagttttgaaagaatctttttgttgaatctgcaagtggacatttgcagcgctttgaggcctatggtgaaaaaggaaatatcttcacataaaaaattcacagaagcattctcagaaactgctttttcatgtgtgcattcaactcaccgagttgaacattccttttcatagagcagttttgaaacactcttttcatagaatttgcaagtcgatatttggacggctttgaggccttcattggaaacggtatatcttcacataaaaagtacacagaggcattctcagacacttctttgtgatgtgtgcattcaactcacagagttgaacctttctttcaatagagcagttttgaaagactcttttggtagaatctgcaagtggacatttggagagctttgtggcctatggtgaaaatgaaacatcttcacataaaaactacacagaagcattctcagaaacttctttgtgatgtgtgcattcaactcacagagttgaaccattcttttgatagagcagttttgagaaacttttttgtagaatttgaaagtggatattttggccgcttagaggtcttcgttggaaacgggctatgttcacattaaagctagacagaagcattctcagaaacttctttgtgatgtgtgcattcaactcacacagctgaatatttcttttgatagaccagttttgaaacactcttattgtagaatctgcaagaggacatttggaacgctttgaggcctgtggcgaaaaaggaaatatcttaacataaacactagacagaagcattctcagaaacttgtttgtgatgtgtgcattcaactcaaagagtttaaccattattttcatagagcagttttgagacactctttttgtacagtttacaagtggatatttggaccgctttgaggccttcattagaaaggtgatatcttcatataaaaactagacagaagcattctgatgaacttctttgtgatgtgtgcattcaactgagagagttgaacctttcttttgatagagcagttttgaaacactctttttgtagaatctgcaagtggacatttggagcactttgtggccttagttgcaaacggtatttctttgcataaaaactacacagaagcattctcagaaacttctttgtgatgtgtgcattcaaatcacagagttgaacatttattttgatagtgcagtttcgaaacactctttttgtagaatctgcaagtggagatttgcagcgctttgtggcttatggtgaaaaaggaaatatcttcacataaaatgtacacagaagtattctcaggaacttctttttgatgtgtgcattcaagtgacaatgttgaaactttcatttgatagagcagttttgaaacactccttttgtagaatctgcaagtggacatttggagtgctttgaggccttcgttggaaatgagatatctttacataaaaactagacagtagcattctcagaaacttctttgtgatgtgtgcattcaacccaccgaggtgaaactttttatagagcagttttgaaacactctttttgtagaatctacaattggacatttggagcgctttgtggcctatggagaaaaaggaaatatcttcacttaaaaactagacagaagcattctcataaacttctttgtgatgggtgcaatcaactcacggagttgaacctttcttttgatagaggagttttaaaacactctttttgtggaatctgcaagttgacatttggagctctttgagtcctatggtgaaaaaggaaatatcttcacataaaaactacacagaagccttctcagaatcttctttgtgatgtttgctttcaactcacagagttgaacactacttttcatagagcagtattgaatcactctttttgttgaatttgcatgtggatatttggaccactttgtatcattcattggaaatgagatatcttcacataaaaacaagacagaagaattctcagaaacttcctcgtgatgtttgctttgaactcacagaattgaacattccttttcatagagcagttctgaaacactctttttgtacaatttgaatgtggaaatttggaccgcattgaggcattcattggaaaaaggatatcttcactaaaactggatagaattattctcagaaacatctttgtgatgtgtgcattcaactcacagagttgaacctttcttttgatagagctgttttgaaacactctttttgtagaatctgcaagaggacatatagaacgctttgaggcctgtggtgaaaaaggaaatatattgacattaaaactagacagaagcattctcagaaacctatttgtgatgtgtacattcaactcacaaatttgaacctttcttttgaaagagaatagttgaaacactccttttgtacaatctggaaatggacatttatagcgatttgaggtctgtgttgaaaaaggaaacatcttcacataagaactatacagaagcattctcagaaacttctttgtgatgtttgctttcaaatcacagagttgaacatttcttttcatagagctgttttgaaacactctttttgtagaatttacaagtggatatttggaactctttgaagccttcattggaaacgggatatcttcacaaaaaccaaacagaagaattctcagaaacttctttgtgatttgtgcattcaatgcaaaaagttgaaccgttcttttcatagagcagtttggaaacactattttagtagaatctgcaagtgagcatttgcagtactttgaggcctatggtgaaaaaggaaataccttcatataaaaacaacacagaagcattctcaggaccctgtttttgtagaatttgtaaatggatatttggatcgctttgagacctatggtgaaaaagtaaatatcttcacataaaaactacacagaagcattctcagaaacttctatgtgatgtgtgcattcatctcacagagttgaaccatttttttgatagagcagttttgaaacactctttttgtagaatctgcaagtggacatttggagcgatttgggtcctgtggtaaaaaaggaaatatcttcacattaaaacaacgcagaagcattctcagaaacttctttgtggtgtttgctttcaattcacagatttgaacattccttctcatagagcagatttgaagcactcttttgtagaatttgcaaggggatatttcaactgctttgaggccttcgttggaaatgggatatcttcacaaacac

SEQ ID NO: 2251 - DNA, 1300 bp, artificial
  synthetic oligo
ttatttgctttgaactcacagagttgaacattccttttcatagagcagttttgaaacactctttttgtagaatttgcaagtggatatttgtaccactttgaggctttgaggccaaaggtgaaaaaggataaaccttcacataaagtctatacagaaacattctcagaaacttctttgtgatgtgtgcactcaactcacagagttgaaacttcttttgattgagcagttttgaaacactctttttgtagaatctacaagtggatatttggagcgctttgaggcctgtggtgaaaaagggaatgtcttcacaaagaaactacacagaagcattctaagaaacatctttttgatgtttgctttcaagtcacagagttgaacattccttttcatagggcagttttgagacactctttttacagtatttgccagtggatcttcggtccgcattgaggacttctttggaaacgggatattttcacaaaaactggaccgaagcattctcagaaccttctgtgggatgtgtgcattcaactcacagatttgagcctctcttttgatagagcagttttgaaatcctctttttgtaggatctgtaaagggatatctggagcgctttgaggcttatgatgaaaaaggaaatatcttcacataaaaactacacagaagcattctcagaaactactttgtgtggtttgctttcaactcacagagttgaacattccttttcacagagcagttttgaaaaactatttttgaattacctgccattggacatttggagcgctttgaggcccatggtgaaaaaggaaatatattcacaacgaaactacacggaagcattctcagaaacttctttgtgatgtttgctttcacctcacagagttgaacattccttttcatagagcagttttgaaacactatttttaatttgaaagtggatatttggacctctttgaggccttcgctggaaacgggatatcttcacaaaaactggacagaagcattctcaggaacttctttttgatgtgtgcaatcaactcaccgagtttaacctttcttttgatagttcagttttgaaacagtctttttgtagaatctgcaagtgggcatatggagcgctttgatgcctatggtgaaaaaggaaatatcttcacataaaaactagacagaatcattctctgaaacttctttgtgatgtgtgttctcaactcacggagttgaacctttcttttgatagagcagttttgaaacactttttttagaatctgcaagtggatatttggagagctttgaggtctgt

SEQ ID NO: 2252 - DNA, 1850 bp, artificial
  synthetic oligo
actacacagaagcattccgagaaacttctttttgatatttccactaaactcacagagtttaatctttcttttgattgagcagtttggaaacagtcttttcaaagtatctgaaagtggatattttgagaggtttgaggccaatggtggaaaaggaaatatcttcacatagaaactagaaagaagcattttgagaaacttcttcttgatgtgtgcattcatctctcagagttgaacctttcttttcattgagcagatttgaaatactctttttatagaatctgcaagagtttagttgaagcgctttgaggcttgtagtggaaaaggaattatcttcacatacaaattacacagaatcattctgagaaacttctttgtgatgtctgcattcatctcacaaagttgaagctttcttttgtttgagcagttttgaaaaactctttttgaagaatatgcaagtggttatttgagctctttgaggtctattttggaaaaggaaatatcttcacataaaaactacacagaagcattctgagaaacctctttgggatgtgtgcactcatctcacggagttgaacctatcttttcaatgagcagttttgaaactctcttttttttagaatctacaagtggatatttggagccctttgcggcctttggtggaaaaggaaatatcttcacataaaaactaaacagcagcatagtgagaaacttctttgtgatgtgtgcattcatctcacagatttgaagctttcttttgatcgagcagttttgaaacactctttttgtggaatctgaaagtggatatttgggagctttgagtcctactgtggaaaaggaaatatcttcacataaaaaagacagagaagcattctgagcaacttctttgtgatgtgtgcattcatctcacagatttgtacctttctcttgattaagcagtttggaaacacacttttatagaatctgcaagtggatattcgaagcactttgaggtctgtggtggaaaaggaaacatcttcacatagaaactacacagaggcattttgagaaacttgtttgtgctgtgtgaattcagcccacaatgttgaacttatcttttcattgagcaattttgaaactttctttttgtacaatctgcaagtggatatttggagccctttccggcatatggtggaaaaggaaatatcttcatataaaaactacacagaagcattctgagaaccttctttgtgatgtgtgccttcatctaagagttgaacctttcttttgattgagcagttttgaaacactctttttgtagaatctgcatgtggaaattcggaacgctttggggcctattgtggaagtggaaatatcttcacataaaaactacacagaagcattgtgagaaacttctttgggatgcgtgcattcatcttacagagttgaacctatcttttgattgagcagtttggaatcactctttttgtagaatctgcaaatggttatttggagccctttgcggcctattttgtaaaaggaaatatcaccacataaaaactacacagaagcattctgagaaacttctttgtgatgtgtgcattcgtctcacagagttaaacttttcttttgattgagcagttttgaaacactctctttatagaatctgcagttggatatttgaagagctttgaggcctattgtgtaaaagaaaatatcttaacataaaaactacacagaagcattctgagaaacttctttgtgatgtgtgcattcatctcacagacttgaaattttcttttgtttcaccagttttgaaagactctttttgtagaatctgcaagtggagatttggagctctttgaggcctattg

SEQ ID NO: 2253 - DNA, 3950 bp, artificial
  synthetic oligo
agacagaagaattctcagaaaatactttgtgatgtttgcattcaactcacagcgttgaacatacctttttatggagtagttttgaaacactctttttgtagaatctgcaagtgtatatttggagcgatttgaggccttcgttgtaaacgggaatatcttcacataaaaactagacaaaagcattctcagaaacttctttgtgatgtgtgcattcaactcatagaattgaaccttccttctgatagagcagttttgaaacactctttttatagaaacttcaagtggatatttggagcgctttgaggccttcggtggaaacgggaatgacttcacataaaaactagacagaagccgtctcagaaacttctttgtaatgtgtgcattcaacacacagagttgtgcctttcttttgatagagcagttttgagacactctttttgtaggatctgcaattggaaagatggagagctttgaggcctgtggtggaaaacaaattatcatcttcatacaaaaactagacagaagcattctcagaaacttctttgtgatgtgtgcattcaactcacagagatgaaccttcctttttacatagctgttttgaaacactctttttgtagaatcttcaagtggatatttggagccatttgattcctaggctgaaaaagggaatatcttaacataaaaactagacaaaagcattctcagaaacttctttgtgatgtgtgcattcaactcagagagctgaaccttccttttgatagagcagttttcaaacactctttttgtagaatctgcaagtggataattggagtcctttgattccttcggtgaaaaagggaagatcttcacgtaaatactggacggaagcattctcagaaacttctttgtgatgtgtgcattcaactcacagagctgaacctttctttggatagagcagttttgaaacactctttttgtagaatctgcaagtggacatttggagcgctttgaggcctgtggtggaaaaggaaatatcttcatatgaaaactagacagaagcattctcagaaacaactttgtgatgtttgcattcaactcatagagtagaacattccttttgatagagcagctttgaaacactccctttgtagaatctgcaagtggatatttggaccgctttgtggccttcggtggaaacgggaatatcgtcacgtaaaaactagacagaagtattatcagaaacttctttgtgatgcatgcattcaactcagagggttgaaacttccttttgatagagcagttttgaaacaatctttttgtagaatctgcaactggatatttggagcggtttgaggcctatggtaggaaaggaaaagtcttcatataaaaactggacagaggccgggcgcggtggctcacgcctgtaatcccagcactttgggaggctgaggcgggcagatcacgaggtcaggagatcgagaccatcctggctaaaacggtgaaaccccgtctctacaaaaaatacaaaaaaattagcagggcatagtggcgggtgcctgtagtcccagctacttgggaggctgaggcaggagaatggcgtgaaccctggaggcggagcttgcagtgagccgagatcccgccactgcactccagcctgggcgacagagtgagactccgtctcaaaaaaaaaaaaaaaactggacagaaacattctcagaaattatttgtgacttgtgcattcaactcacagggttggacctttcttttgataaagcagttttgaaaacattctttttttaggatctgcaagtggacatttagagcgctttgatgtgtatggtgaaaaatgaaatatcttcacataaaaactagacacaggtattctcaataactcctttgtgatgttagcattcaactcatagtgttgaacattccttttgatagagcagttttgaaacactctttttgtagaatctgcaagtggacatttggagcactttgaggcttgtggtggaaaaagagatatcttcatataaaaactagtcagaagctttatcaaaaactcctttgtgatgtgtgcattcaacgcacagatttgaacattcctttttataaagtagttttgaaacactatttttgtagaatctgcaagtggatatttggagcgctttgaggccttcggtggaaacgggaatatcttcatataaaaactagacagaagtattctcagaaactcctttgtgatgtgtgcattcaacttagagagttgcacattcctcctgatagagcagctttgaaacactcttgtagaatctgcaagtggatatttggagcactttgaggccttctgtggaaacgggaatatcttcacataaaaactagacagaagcattctcagaaacttctttgtgatgtgtgcattcaactcacagtgttgaaccttccttttgacagagcagttttgaaacactctttttgtagaatctgcatgtggatatttggagcgccttgaggccttcggtggaaatgggaatatcttcacataaaaactagacagaagcattctcagaaacttctttctgatgtgtgtattcaaatcacagatttgaaccttccttctgatagagcagttatgaaacactctttttgtagaatctgtattagaacatttggagtgctttgaggcctgtggtggaaaacgaaatatcttcacataaaaagtagacagaagcattctcagaaacttctttgtgatgtgtgcattcaactcagagaattgaaccttcgttttgatagaccagttttgaaacactgtttttctagaatcttgaagtcgatatttggatcgctttgtggtttatggtagaaaaggaaatatcttcatataaaaactagacggaagcattctcagaaactactttgtgatgtttgcattcaaatcacagagttgaacattccttttgatagagcagttttgaaacactctttttgtagaatctgcaagtggatatttgtagctttttgaggcctatggtggaaacagcaatatcttcacctaaaaactagacagaagcattctgagaaacttctttgtgattcatgcatggaactcagagagttgaaacttccttttgattgagcagttttgaaatacgctttttgtagaatctgcaactgtatacttggagtgctttgaggcctacagtaggaaaggaaatatcttaatataaaaactacacagaagtataatcagaaactactttgtgatgtctgcattcaactcagactgttgaacatttcttttgatagagcacttttgaaacactgtttttgtagaatctgcaagtggacgtttagagcgctttgatgcctatggtgaaaaaggaaatatcttcacataaaagttggacagaagcattctcagaaacttctttttgatgtgtgcatacaactcacagagttgaacattgcttctgatagagcaattttgaaaccctctttttgtaaaatctgcaagtgaatattttgaccactttgaggccttcatttgaaacggaaatattttcatataaaaactagacagaatcattctcagaaacttcttcatgatgtttgcaatcaactcacagaattgaatcttccttttgatagagcagttttgaaacactctttttgtagaatcggcaagcacatattttgagccctttgaggccttcagtggaacagggaataccttcacataaaaactagacagaagcattcccagaagcttctttgtgctgtgtgcattcaactcacggagatgaacctttcttttgatagagcagttttgaagcactctttacgtagaatatgcaagtcgacatttggagtgctttgaggcatgtggtagaaaaggagatatcttgatataaaaactagacagaagcattctcagaaacaactttgcgatgtttgcattcaactcacag

SEQ ID NO: 2254 - DNA, 1950 bp, artificial
  synthetic oligo
cttcacataaaaactggacagaagcattctcagaaactcctttgtgatgtgtgcattcaactcacagagttgaaccttccttttgatagagcagttttgaaaccctcttttggtagaatctgcaagtgtacatttggagcgctttgagacctgtgctggaaaaggaaatatcttcacataaaaactagacacaaggattctcagaaacttctttgggatgtgtgcattcaactcacataagtgaaccttccttttgatagagcagttttgaaacactctttttgtggaatctgcaagtcgacatttggagcgctttgatgcctgtggtgaaaaagaagatatcttcatataaaaactagacagaagcattctcagaaactactttgtgatatttgcattgaactcacagagctgaacatttcttttgatagagcagttttgaaacactctttttgtggtatctgcaagtggatatttggagtgctttgaagtcttcggtggaaaagggaatatcttcacaaaaaaactagacagaatcattttcagaaacttctttgtgatgggtgcattcaactcacagagttgaacctttcttttgatagagcagttttgaaacactctttttgtataatctgcaagtggacattttgagagctttgatgcctatgttgaaaaaggaaatattttcacacaaaaactagaaagaaacattctcagaaagtgctttgtgatgtgtgtgttcaattcacagagttgaacattccttttgatagagcagttttgaaagactctttttgtagaatctgccagaggatatttggagcactgggaggccttcggtggaaacgggaataccttcacatacaaattagagagaagcattctcagaaacacctttgtgatgtgtacattcaactcacaaagttgaacctttcttttgatatagcagttttcaaacaatctttttgtagaatctgtaactggatatttggagcgctttgaggccttcagtggagatgggattatattcacataaaaactagaaagaagcattctcagaaacttctttgtgatatgtgcattcacctcaccgatttgaacctttctttagaaggagcagatttgaaacactctttttgaagaatctgcaactggatatttggagagctttgaggactatctgggaaaggaaatctcttcatataaaaactagatagaagcattctcagaaactactttgtgatgtgtgcattcaactcactgaggtgatcctttctttcgatagagcagttttgaaacactcatttgtagaaactgcaagtggacatttagagggctttgctccctatggtgaaaaaggaaatatatacacataaaaactagacagaagcattctcagaaacttctttgtgatgtttgcattcaactcacagagttgaacatcccttttgatagagcagttttgaaacactctttttgaaggatctgcaagtggatatttggttccctttgaggcctatgcttgaaaaagaaatatcttcatatgaaaactagacagaagcattctcagtaactgctttgtgatttgtgcattcaagtcacagtgttgaacctttgttttgatagagcagttttgaaacacgctttttgcaggatctgcaagtagatatttcgttctattggaggtctatgtcagaaaacgaaatatcttcacataaatactagacagaagcattcacagaatcttctttgtgatgtgtgcattcaactcaccgagttgaacctttcttttggtagagcagttttgaaatactctttgtagaatctacaagtggatatttgttccactttgaggcccacgttggaaaaggaaatatcttcacgtaaaaactagacagaagcattgtcagaagctgatttgtgatgtgtgcattcaactcacagagttgt

SEQ ID NO: 2255 - DNA, 1900 bp, artificial
  synthetic oligo
agaaacttctttgtgatgggtgcattaaactcacagagttgggcctttctttttatagggcagttttgaagcactctttttgtagaatctgcaaggggatatttggttccatttgaggcctatggtggagaaggaaatatcttcacatacaaactagacagaagaattctctgaaacttctttgtgctgtgtgtattcaactgatggagttgaacctttcttttgatagagcagttttgaaacactctttctgcagtatctacaactgggtattttgttccctttgaggcctacgatggaaaatgaaatatcttcatataaaactagacagaagcattctcggaaactgctttgtgatttgtacattcaactcagagatctgaaccattcctttgatagagcagttttgaaacactatttttgtagaaattgcaaggggatattttgttccctttgaggcctatgttggaaaacaaaatatcttcacataaaaactagacagaagcattctcagaaacttctttgtgctgagtgcattcaactcacagagttgaacttttcttttgatagagcagttttgaaaccctctttctgtagaatctgcaagtggatatttggaatgctttgaggcctatggtggaaaaggaaatatcttcacataaaaactagacagaagcattctccaaaacttctttgtgatgtgtgcattcaactcacagagttgaacctttctttttgtagagcagttttgaaacactctttttgaagaatctgcaaggggatattttgttccatatgaggcctatgttggaaaacgaaatatcttcaaataaaaactagtcagaagcattctcagaaacttcttactgatgtgtgcattcaactcacagagttaaacctttcttttgatagagcagttttggaacactctttcgtagaatctgcaagtggatatttggaactctttgaggcctcttgtctaaaaggaaatatcttcataaaaaaactagacagaagcattctctgaaatttatttgtgatgtataaactcaactcacagtgctgaagccttcttttgataaagcagctttgaaacactctttttgtagaatctgcaagtggatatttggagcgctttgaggcctatggtggaaaaggaaatatcttcacataaaaactagacagaagcattctccgaaactactttgtgctgtgtgcattcaactcgcagagttgaatctctctattgatctagcatttttgaaacactctttttgtagtatctgcaagtgtatttttttttctgtttgaggcctatggtggaaaaggaaatatcttcacataaaaactagacagaagcattctccgaaacttctttttgctgcatgcattcaactcgcagagttgaatctttctattgatggagcagttttgaaacactctttttgtagtatctgcaagtgtatatttttttccttttgaagcctacgttggaaaacgaaatatcttgaaataaaactagacaatagccttctcagcaactgctttccgatgtgtgcatttaactcagagagttgaacatttcgtttgatagagcagttttgaaccactcttttcgcagtataagcaggtgaatatttggaacgctttgagccttatggtggaaaaggaaatatcttcacattaaaactagagagaagaagtctcagaaacttctttgtgatgtgtgcactcaactcaatgttttgaacctttcctttgttagagtacttgtgaaacactctttttgcagaatctgcaagtggatatttggagtgcttttaagactatgtggtaaaggaaatatcttcacataaaaactagtcagaagcattctccgaaacttctttttgatgtgagc

SEQ ID NO: 2256 - DNA, 4050 bp, artificial
  synthetic oligo
tttgaggcctatgttacaaaacgtaatatcttcacataaaaaatagacagaagcattctcagaaactgctttgggatgagtgcgttgaattcagagagttgaacctttcttttggtagagcagttttgaaacactctgcttgtagaatctgcaagtggatatttggagagctttgagacctatgctggaaaaggacatatatcacatgaaaactagacagaagcgttctccgaaaattctttgtgctgcgtgcattcaactcacagtgttgaaactttcttttgatagagcaggtttgaaagtctctttttgtagaatttgcaatggatattttgttccctttgaggcctatgttggaaaacgaaataacttccctcaaaaactagacagaagcattctccaaaacttctttgtgatgtttgcattcaactcacaaatttgaaactttcttttgatagagcagttttgaaacactctttttgttgtatctgcaaggggatattttgttccctttggggccgattttggaaaacgaaatatcttcccataaaaactagaaaaaagcattccgcgaaacttctttgtggtgtgtgcattcaacttacagagttagtactttcttttgatagagcagttttgaaacagtctttttgtagaatctgcaaggggatatatcgtttcctttgaggcctataatggaatacgaaatatcttcacataaaaagtagacagaagtgttctcagaaacttctttgagatgtgtgcattcaactcacagagttgaactttccttttgatagagcagttttgaagcactctttttgtagtatctgcaagtggatttttgcagcactttaaggcctatggtggaaaaggaaatatcttcactataaaactggacagaagcattctccgaaacattttgtgatgtgcgaattcaactcagagttgaacctttcctgttatacagtactttggaacattctttttgtagaatctgcgagtggatatttgcagtgctttaaggcctattgtggaagatgaaatatcttcacataaaaactagacagaagcattctcagaaaattctttgtgatgtgtacattcacctcacagtgttgaacctttcttttgatagagcagttttgaaacactcttttgtagaatctgcaagtggatatttggagcgctttgaggcctatggtggaaaaggaaatatcttcacataaaaactagacagaagcattctccaaaacttctttgtgatgtgtgcattcaactcacacagttgaacctttcttttgatggaggagttttgaaatgctctttttgtagaatctgcaagtggatatttggaacgctttgagaccagtattggaaaacgaaatgtcttcacataaaaactagacagaagcattctccgaaactgctttgtgatttgcgcattcacctcacagacttgaacctttcctttgatagagcagttttgaaacagtctttttgcagaatctgcaagtggtatttggatcggtttgaggcctatggtggaaaaggaaatatcttcacataaaaactagacagaagtattctccaacacacctttgtgatgtgcgcattcaactcacacagttgaatttttcttttgatagagcagttttgaaacagtctttttgaagaatctgcaagtggatatttggttccctttgaggctaatgttggaaaacgaaatatcttcacataaaaactagcagaaacattctcataaactgctttgtgatgtgcacattcaactcacagagatgcacatttcttttgatagagcacttttgaatcactcttttggtagaatctgcaagtggatatttggagcgctttgaggcctatattggaaaacgaaatgtattcccataaaaactagacagaagcattctcacaaactgctttgttatttgtgcattcaactcacagatttgaaaatttcttttgatagagcagttttcaaacaccctttttgtagaatctacaagtggatattttgttccctttgaggcctattttggaaaacgaaatatcttaacataaaaactagacaaaagcattccctgatactttttttgctgtttgcattcaacttacagagttagaacgttcttttgatagagcagttttgaaacactctttttgtagtatctgcaaggggatatttggtttcctttgaggcctatgttggaatacgaaatatcttcacataaaaactagacagaagcattctcagaaactcctttgtcatgtgtgcaatcaactcacagagttgaaccttaattttttagagcagttttgaaacactctttttgcaaaatctgcaagtggatatttggaacgctttgaggcctatggtggaaaaggaaatatcttcacataaaaactagacagaagcattctccaaaacacgtttgtgattagtgcattcaactcacacagttgaacctttcttttgatagaggatttttgaaacactctttttgtagaacctgcaagtggatattttgagcaccttgaggccaatggtggaaaaggaaatatcttcacatagaaactacacagaagcattctcagaatcttccctggatgtatgcattctgctcacagagttgaaccacgcttttgatagagcagtttttaaacactctttttgtataatctgcaagtagatattttgagcactttgaggtctatggtttaaaaggaaatatcttcacataaaaactagacagaagcattctctgaaacttctttctgatgtgttctttcaactcacagagttgaacctttctgttgatagagcagttttgaaacactcttttgtaaaatctgcaagtggatatttggagcgctttgaggcctgtggtggaaaaggaaaatcttcaaataaaaactagataaaagcattctcggaaacctctttgtgatgtgtgcattcaactcacagagttgaactttccttttgatagagcagttatgaaacactctttctttagaatctacaggtggatattttctttccattgaggcctatgtaggaaaacgaaatatcttcatataaaaactacacagaagccttctcagaaacttctttgtgatgagtgtattcaactcacagagttgaccatttcatttgatagagcagttttgaaacacactttttgtagaatctgcaagtggatatttggagtgctttgaggcctatggtggaaaaggaaatatcttcatataaaaaccagacagaagcattctcaaaaacttatttgtgatgtatggattgaactcacagagttgcacatttcttttgatagagcagttttgaaacactctttttgtagaatctgcaagtggatatttgtagcgctttgaggcctatgtaggaaaatgaaatatcttcatattaaaactagacagaagccttctcagaaacttctttgtgatgtgtgtattcaactcacagaattgaacgtttcttttgttagagcagttttaaaacacactttttgttgaatctgcaactggatacttggagcgctctgaggcttatggtggaaaaagaaatatctttacataaaaactagacagaagcattctcagaaacttcttcatgatgtgtgctttcaactcacagagttgaacatttctttttagagagcagttttgaaacattctttttgtagaatctgtaagtggatatttggatcgctttgagacctatggtggaaaacgaaatatcttcccataaaaactagacaaaagcgttccccgaaacttctttgtaatgtgtgtgttcaacttgcagagttagaaagctcttttgataaagcagttttgaaacactctttttgtaggatctgccagggaatatttggttttctttgaggccaatgttggaatacgaaatatcttcacttaaaaactagacagaagcattctcagatactcctttgtcatgtgtgcattcaactcacagagttgaacctttctttttttagagccgttttgaaa

SEQ ID NO: 2257 - DNA, 1450 bp, artificial
  synthetic oligo
ttgttccctttgatgcctatggttgaaaaagaaatatcttcacataaaaactacacagaagcattctcagtaactgctttgtgatgtgtgcattgaactcacattgttgaacttttgttttgatagagcagttttaaaacactctttttgtagaatctgaaagtggatatttggagcgctttgaggtctatggtggaaaatgaaacatcctcacataaaaactagacagaagcattctcagaaacctctttgtgatatgggaattcaactcacaaagttgaacttttcttttgacagagcagttttgaaacactctttttgtagaatctgcaaggggatgttttgtacctttcgaggcctatggtggaataggaaatatcttcacataaaaactgcccagaatcattctccgaaacttctttgtgacgtgtgcattcaacacacagagttgaacctttttttggatagagcagttttgaaacacactttttgtaggatctgccagtggatattttgttccattggaggtctatgttggataacaaaatatcttcacataaaaactagacagaagaattatcagaaacttctttgtgatctgtgcattcaactcacagagttgatcctttcttttgatagaggagttttgaaacaatctttttgtagaacctgcaggtggatatttggagcgcttggaggcctatggtggagaaggaaatatgttcacataaaaactagacagaagcattctttgaaacttctttttgctgtatgtattcaagtaacggagttgaacctttcttttgatagagcagttttgaatcactctttctgtagtatctacagctggttattttgttccctttgagacctacgatggaaaacgaaatatcttcacataaaacgaaacagaagcattctcagaaactgctctgtgatgtgtgcattcaactcggagagctgaacctttcctttgatagagcagttttgaaacactatttttgtagtatctgaaaggggatattttgttccctttgaggcctatgttggaaaaaaaatatctccacataaaaactagacagaagcattctcagaaacttctttgtactgtgtgcattcaactcacagagatgaacttttcttttgatagagcagttttgaaacaatctttttgtagaatatgcaagtggatatttggagtgctttgagtcctatggtggaaaaggaaatatcttcatataaaaactagacagaagcattctcagaaacttcttcgtggtgtgtgcattcaacttacagagttgaaatttcttttgatagagcagttttgaaacactctttttgtacaatctgcaagtggatatttggagcgctttgaggcctatggtggaaacggaaatatctgcacataaaaactggacagaagcattctccaaaacttctttgtgtt

SEQ ID NO: 2258 - DNA, 1850 bp, artificial
  synthetic oligo
acacacttttgtagaatctgcaagtggatatttggagtgctttgaggcctgtggtggaaaaagaaatatcatcacgtaaaaatcagaccgaagcattctgagaaactcctttgtgatgtgtgcatttatctcacagagttgaatgtttcttttcattgagcagtttgaaacacatttttttgtagaatctgcaagtggatatttggagcgcttgaggtctatggtggaaaaggaaatatattcacataaaaactacacctgaagcattctgagaaacttctttgtgatgtgtacgttcaacccagagttgaacctttcttttaattgagcagttttgaatcactctttttgtagaatctgcaagtgtatatttacagcgatatgaggcctacagtggaaaaggaaatatcttcaaataaaagctagaaagaagaattcggagaaactaattcttgatgtgtgcactcatctcaaagtgttgaacttttcttttgattaagcagttttgaaacactttttttgtagaatctacaagtggacaataggagcgctttgcagcctataatgcaaaaggatatatcttcacataaaatctagacagaagcattctgagaaacttctctgtgatgagtgcattcatctcacagagttgaacatttcttttgattgagcagttttgaaaaactccttttactgaatttgcaagtggatatttggagcgctttgaggcctgtggtggaaaaggaaatatcttcaaataaaaactagacagaagcattctgagaaacttgtttgtgatgtgtgtattcatctcactgtgttgaaactttcttttgactcagcagttttgaaacactcttttggaagaatctgcaagtggatatttagagagatttgaggcctgcgttggaaaattaattgccttctcataaatactacatagaatgattttgagaaacttctttgtgatgtgtgcattcatctcacagagttgaacctttcttttgactgagcagttttgaaacactctttttgtagaatctggaagtggaaatatggagcgctttgtgtcctatggtggaaaaggaaatatctagacataaaaactagacagaagaattctgagaaacttctttgtgatgtgtgcattcaattcacagagttgaacctgtcctttattgagcagttatgaaacactatttttgtggaatctacaagtggatatttgcagcgctttgctgcgtctagtggaaaaggacatatcttcacataaaaaatggatagaagcattcttagaaacttctttttgatgtgtgcattcaactcacagtgttgaacctatcttttcattgaacagttttgaaacactctttgtagaatctgcctttggatatttgaaccaccttgaggccagtgcttgaaaaggaaataccttcaattaaaatttacacagaagcattctgagaaacttctttgtgatgtgtgcattcaactcacagagttgaaattttctttttattgagcagtttagaagcagtgtttttgtgatacctgcaaatggatgttaggagacgtttcagacctatggtggaaaaggaaatattttcacataaaaacaagacagaagcattctgagcaacttctttgttatgtatggattgaactcacagagttgaaccttgctattgattgattgagcacttttgaaacactctttttgtagaatctgcaatggatgttaggagcggtttgtggcctatagtgcaaaaggaaatatcttcacataaaaactagacagaagcattctgagaaacttctttgtgttgcttgcatttgtattacagagttga

SEQ ID NO: 2259 - DNA, 1950 bp, artificial
  synthetic oligo
gaaatatcttcactaaaaaacaagacagaagcattatgagaaacttctttttgaagcttgagttcatctcacagagttgaaactttcttttgattgaacagttttaaaacactctttttgtagcatctacaacggatatttggagcactttgaggtctatgatggaaaaggatatatcttcacataataactagacagaagcattctcagaaacttctttgagatgtgtgcatttaactcacagagctgaacctttcttttgattgagtggtttggaaacagtctttttgaaatatctgcaaatggatacttggaagtctttgaggtctatggtggaaaaggaaatattttcacgtaaaaactagacagaagcattctgagaaatgcctttgtgatatgtgcattcatctcacagagttgaagctttcttttgagagcgcagttttgaaacactctgtttgtagaatctgcaagtggatatttggagcgttttgaggtctatggtggaaaaggaaatatcttcacataaaaactagacagaagcattctgagaaactattttctgatatgtacattcatctcacacacttgaacatttcttttcattgacaagtttggaaacagtctttttgtagtatctgcaaatggatatttgctttgaagcctatggtggaaaaggaaatattttcacataaaaactagagagaagcattctgagaaacttctttgtgatgtgtgcattcatctcacaaagttgaacctttcttttgattgagcagttcggaaacagtctttctgtagtacctgtatggagtgctttgaggcctacgttggaaaaggaaatatcttcccataaaaactagatagaagcattctgagaaacttctttgtgatgtgtgcattgaactcacagagttgaaccttcttttgattgagcactttggaaacagtctttttgtattatcatcaaatggatatttggagcgcttttaggactatagtggaaaaggaaatatcttcacataaaaactatacagaagcattctgagaaacttgtttgtgagttgtgcattcatctcacagagttgaaactttcttttgattgaacacttttgaaatactctttttgtagaatctgcaaatggatatttggagcgctttgaagcctatggtggaaaaggaaatatcttcacatataaactagacagaagcattctcagaaacttctttgtgatctgtgcattcaactcacggagttgaacttttcttttgatagagcagttttgaaacagtctttttgcagtatctgcaaatggatatttgtagcgctttgaggcctatggtggaaaaagaatatcttcacataaaaactagacagaagcattctgacaaacttctttgtcatgtgtgcatgcatctcacagagttgaagccttcttttgattgagcattgttgaaagacacttttcatagtctctgcaaatggatatttggagtgctttgaggcctatggtggaaaaggaaatatcttctcataaatactacatagaatgattttgagaaacttctttgtgatgtgtgcattcatatcacagacttgaacctttcttttgattgagcagttttgaaacactctttttgtagaatctgcaagttgatatttggagtgctttgcggcttatagtgttaaaggatatacctaatgctagatgatgagttagtgggtgcagcgcaccagcatggcacatgtatacatatttaactaacctgcacaatgtgcacatgtaccctaaaacttaaagtataataattaaaaaaaagaaaaaaaagaaaatatcttcacataaaaactagaaggaagcattctgagaaacacgtttgtgatgcatgcttttatctgacagtgttgaacctttcttttgattgagtagttttgaaacactctttctg

SEQ ID NO: 2260 - DNA, 1350 bp, artificial
  synthetic oligo
taaacaccacatgttctcactcataggtgggaattgaacaatgagaacacttggacacaggaaggggaacatcacacaccggggcctgttgtggggtggggggaggggagagggatagcattaggagatatacctaatgtaaataacgagttaatgggtgcagcacaccaacatggcatatgtatacatatgtaacaaacctccacgttgtgcacgtgtaccctagaacttaaagtataataaaaaaaaattggcaatgacattgaacagacacttctcagaagaagacatataagcaacaaaaactcatggaaaatgctcagcatcactaatcatcagagaaatgcaaatgaaaaccaaattgagacaacatctcacacgagtctgaatgggtattaaaaagtcaaaaaacaatagatgctggtgaggctgcagagaaaagggaacacttatgcattcctggtggaaatgtaagttagtagagccactgtggaaaacactctggagatttctcaaacatctcaatacggagttaccctttgatgcagcagttcaattactggctatgtacccaaaggaaaataaatcattctaccagaaaggcatatgcactcttatgttcattgctgtgctattcacagtagcaaagacatggaatcaacccagatgacaatcaacggtagattggataaggaaaatgtggtacatatatataccatggaatactatgcagccataaaaatgtaataaaatcttttttctttttctttttagcagcaacatggatgcagggggaggccataatcataagggagttaacacaagaagaaacaacaaaattccacatgttttcatggataagtgggagcttaacactgagcatgggaacatgaacatgaacacgagaaatatagacactgtggactcctagaggtaggtggtagggaatggaatgttggttgaaaaactacttattgaacgttaggctcactacctgggtccaaaattgccatgtaacaatcctacacatgtaacccctgtatctccctgtatcttaaacaaaagttgaaattcggaaaagaaactgccttcacggtatcccttatgtgttgctatatcgtgttttcagtttcatttgtctcaagatatttcatgatttcccttttttgatccattgcttattcatgtgtgtgttgttttgtttccacatatttgtgtattttccaattgtcctgttgttattaatttctagatccatcttattctgattgaaaaagaggtttgctattatttcaatcttcttaaatttgttaagacttggtttgtggtgtaacatgtaacttgtcctgg

SEQ ID NO: 2261 - DNA, 1550 bp, artificial
  synthetic oligo
tctaaattttttgaaacaaaagggggtttcaagatgactgactagaaatattttatgcctacctctttcacttggatgaaccagagtagtgcatagacagtaacacttcctagagaaaatgctggaattcaacatagaagtgacagggggcactaaaaacaggaaaggagaaggaggagaggcagcctccctggccaggattggccaagagccagtactgactccccagtgcaggggagggatgagtaagagactgccagtgtcccatgaccccaccatagaagtgtgcaatcctggccacttgaaaaatgcttaaccttctcgaacctggaaactaacagagaaagttgccaggagactgtggggacagaactgctccagggagggagttcatgctgacaccctttctgagatctaagttgatagaaaggtgccattttcaaaactagcctccagcaaactgcatgcttttctgagacccagaggcaccaggactagacgttccggaaactcaggctgccacagctgggactgggcagggagctagcactacccctttagctggggctaagaagtgcatgaggcctggatggtagcagccagtgccataaaatgagtattgcactgccaggacctaaaatgaagtcatgaagagggcatgagttgccactgggacttgatcatgagctgagtgtgggctcctgcagtctgggcaagaagttgagtctcactgggactgagctgtgaaggggagaacatgcattctccacaccatggcccaggctgtgactaccgagggtagcccatcatctctgggcattatccccaacacagaggccaccaccctcacccaatgactctccctggggcatgagaaatacccttaccccctgcccaccgtggctggtgagtactctcaaaatagggggcctgagcacaagactgtccagccgagtttgctccccattccaagacagatcacataatctagagacctgagtattgcacaagccaaaccaccaccttgggcacgtgagcattcctccaagggtcctgagattgggcgtaaacttcacgctgctaccacctcacctggaaactatctgtaagaaccacccgcgggcctggagacttgcccacccagaacattgcagccagtgccaacatcaatgcacaccacgtgagacccagagaatcttcctgccattgctactcccattccccatgcaacaccagttgcccataggacggagaactcacccaacaatctcgtccaccactgccacgacaggaatcctagcaagccatctggagctccaaaaatcaacccattagtaactgccagcacaggtgccagtgtgcaccaccctggggcacaagataggcatgctaagcccaccactgtctacactggggccggaagactggcccaactggcattcaagtccccagcacaataccatcacagcctccataaacaaacgtgccctaacccactgaggaaatcacagataccactaatgctgtttacggccaaattgatcataaag

SEQ ID NO: 2262 - DNA, 1550 bp, artificial
  synthetic oligo
gaatttccggaactctttgagcacaaaatatattctgttttaaagctaaatccattatgtcctgctttttcaaagaggagaaagtaatacacagaaactacagttgtagtactgaccctcagccaagttctgaacccagtttagaaacatttgcattgtaggcacagaaagaaaacaagaagctctggagcctgcaaccagatttaccatgagtaagaggccaagtaacttatactgctttttctgatggggctatcagtttggcagatgcttgctatgaacctagcatatcttgatgcccacaaagcatacaacaaatctatcgtgctatgttattcacattaacaccctggtaggataaatgctggcacaaccaggtgcagtctgcactggttgaccagatacatacaaaaattaacaagtcccaactccaagaggggctctggtgaggtgacagaagagctagcattaatcatatcatagtaaacatttctttgaatcaacgactcgaatgccatttatttggtgttcaaataatgcaacactagaagaggctgctaacctgttgtgtgacatgaagaaaaaaaataaaaacctcccaaaggctagaacaatagtccaaccaaacaaatagaatttaactgatgcagtgctagaagggactgctaatttgtagcacagcatgaagaaaaaattttaaaatccacagaaagctagaataatggaccaacatgtcaagataaaatgtagcaagtttggttcaaaaaaccctgaagtggccaacttcacaagagagtagaggactggactagacagtaaatggtttggacctacatgctcaaaaggctaactcttaaccctggctgcacatttgaatcaccttagggaactttaaattaaaaaaataaataaataaagctccctgggatctagcccatgaaaattaaatcagaatctttcagataggggacctggcatgggtatttaaaaaaaagcttcccaagtgatctgaatgttcagtgagggttgagaatcagtagaaggctgcattattagacatttcacagacaaaacaaagttcttttgcacttgatctcagtcaggtggcacctagagtagcatgaacagttctaggcagcagatttttaaagaaatatagaaaaataagtgtgcttcaaagagaagaacaattgtattaaaactacagttccttgaaaacattctgtattttaggcttcagcaattcacactggcctctcaccttgaagatcccaaatagtgagttttcataaaactaaacagaactctttgatgcatattcaagacaaaaaggcattttatagaatgaaaattctgagcaaaagtgctatacaaatgaaagttattaaaaatgtgagtagctgaggaagctagtatgacttcagggatgactcccaaatctcctttctttcttttgtttccttttctttctttttttttgggacggactctcgctctgtcacccaggctggagtgcagtggcatgatctcggctcactgcatcctccgcc

SEQ ID NO: 2263 - DNA, 1000 bp, artificial
  synthetic oligo
atccctcataagcccacaccaccagggccttgggtttgacacacatagctgtttggagtctcagcagagctgttgctcaggctcacacaaagatccaggagttttacagactctggccccaggaatcctggcaaggtgggagatccatctgtacattcctctagaaagaggactgaaaccagagagctaagcagcatcattctgtaggtcccacttccatggcacctcacaagttaaaacccactgccttggaattccagccaaccagtgcaaccagctggagactgcctgagatgaatgagttcctgtggggaggggcagccaccatttctgcagttaggttgactcagacattctagcctgctggctctgggagatccaggtgttcctgatgagaaggagcaccccacaacatagcacagctgctgtaccagattgtggccagattgcttaagtgggaccctgatccatccctcctcactgggtggggcctcccaatgggaatttcagcaactccagccagggttatacagacagatttctgatctttccttcaggcagagcccccaggggaaggggtggccacagtctctgcagtttaatccactcagccattttagcctgctggctctggaaagtctaggtggcctggacaaggaggagcccccacaacacagcgtacctgctgtgttaggttgtggtcagacttattctttaagtgggaccccgatccatccctcctcattgggcaggggttcccagtgggaatttcagcaactccagccagggttatatggaaagaactctgatctctcccttggatgaagaccagagggaaggggtggccaatgtctctgtagtttagttaactcagccattctagcctgctgactctggagagcctaggtactctggataaggaagggtccccccaatgcagcacactttctcaatcaaaaagtagccaagcttctttttaaagcaggtccttgattctttt

SEQ ID NO: 2264 - DNA, 1100 bp, artificial
  synthetic oligo
aaagcttttcagggatgtcacatccccaaacaagaggctcagtgggtcccccacagggccattgggtgggtttacctctcctgctactaccttctcccctgtttctgggctatggggctcctctaggctactggcttcaggggcaggcttgggttgcacatgtgctgaggcacaggcctccatgggtttttctggatctttacaggccattttctcagtagctggtggagaaggttctggtgttggagaaacttttggcccaggggcatcttgggggttagcattttcctttctaggggcttggaaggtctcctcaaagcagggcacctgaggggctgagctcacgtgctcatgaggcctggctctgaccctctcaggccccttggcccctggctcactttgctcagccccagtgaccttgctcttccggtgacggcggatactgctaaaaaagccttttaggcctttctttggcttgggcatagagggaaacttctcagccacagctttctctgtggctccagccacagatgtcttacatctggagcctgtctccaaagccccatgggcactctgagagctgggaaattggcagggtaactcaggcaaaggcagggagaagccagttccttcactgacaacatcttcagggccatgggctgcttcactcaggccatcgtgggtcttgctcttgctgagacctttcttggagctgcctttcccagaacctttgctccgtccccctccaaagaaactaggcagagtacagatacccttcttgccaccaaagagtttcatggcagttttcttcagcctacctgggccggatgaggatggctctgaggttggtccttctgtcgcctcagctgccttgttcttggctcctttttctgctgtttgttcacgggtactcccagaggctgcagctcccttggcctgagcagcttcatccttttgggtctccatgatgatggggacaactgaggtacgtccagctggaaatgcagcctcaggcttccaggcactgttataacattatcagtcaggaagcatcacagtggggtctggaggagataggagagacaaagacagagagacag

SEQ ID NO: 2265 - DNA, 1050 bp, artificial
  synthetic oligo
tgtgtgtgtccaacacagcacacccatgtcaccccttccactgtgtcacaagcaaaggccattaaaagaaggcccagcataaataaagccaaagacccagaactagccttccacggcccttccatgggaggatactttgcttcctccacaaccattacccagctcacttaccttcataggtgggggctgctgcctgaaggtggccgtctgccgagtatcctgcttcctagccacttggagctgttgggcggcagcggctgcagcggccagggactcagggatggggggctcctgaggttctgtctgccattctgctttctgcttctcaaagtaactttggagatgagagacactggctagatcattctgaaagcaatgagaaccttgctcctcttaaagactccatgccatacaaccaagggttgagctgtggctcattctagaaggtccccacaccttcccaagcacaaggctattgtccctgggtactaggcccaatgtctgatgagaagggtaatcctctttgtccttagctctgataggccaagaagaccaagaaatcttagggctagcaagatccttaaagggtattcagtcctatctgctatctcatgctcttttgagtattcctattaagtgtcctaaggcctctggtgacatatctctaagagtaggaagctcacaaactccacagacaccttgctctacctttaggaaatgatttcctctaccaggtcaaattctgtctctctgcaaggcaagcctagttcttaactctgagccaggagatgaagtaagtcccaggccacttcctgaagaccaggaaagctcagtcttttttgtttttagaggtttctagatatcgccttctagaccctgacttgggaaatgatctcttaagagttatagacatagtcttgtattgtcaatatcacacaaagaatttaaaaagccacctagtagttgttctaattcatctagtaattcatccagtttaataatcctccttctgttttaacaagctggcacagagacttgcccaagatcaca

SEQ ID NO: 2266 - DNA, 2700 bp, artificial
  synthetic oligo
ccttccagcagtgacatcaccaaaggttatcagaaaggcatgctctttctggtgtctcgtgcctgcaaaggagaccagaacgaggggcacaggaccccaggtagggccctgcctggctccctccattcctgattcaacagggaggtgtggtgggggccctcaccatgtttctgtccgggttcaatccagggaggaccttcccaccctcctcagagtggtggcccagcctggcagtggggggtggagcaccagcaggaggaaggcaggaaactggtcatccaagtccagggagtggagcactaccaggaggaaggcggggactggtcactcaagtccagggaagaggccaaaggcacacactggaccttcaggtcccaaacctcaatccttgatcctctgccactggagctgccaccaggcacttcagaacaggggaaactgcccatcttgaggtgggcacaaaggcacgtttctaggtgagggtggcagctgcagcttgatcggatggtcctgagatagcagcagggcccagcatccggggaaagggggggaagggagggcaggctgcagaggggccctgtgggaggccctggccagctttgcacagcccgggcatggccccgggcgcaaaagtcacttctccgtggtctgagaaatctgctgaggcagccctccccatgtggtgacccatgagactgttagccagcccctgctcctcaggaggacaatgccgggccagggcccccagttgccctcctcctgcggggtgcagcgtcctcagccctgctccaggctgtcgctgggctgcaccacggtgtagctcccctggcccaaggacagctgctggctgaagaaggacgtggtgctcttcgtcttcactcgcctgatccccttgccgtcctccacataggcgatggtggagagatgctggatccggctggacaccacactgccctgcctccgcagcttggggcgctgaacaggagctggcgaggagctgaggtctgagggcgagccagttgcactgtcctgggggcctgcgggctccgccgcctggctcagttagatgcagtactcaatgaggctgctcatcagttcggcctgcttggagtagatcttgaggagcttgttgacaggtgtgaccccgctgtccctgtcgaactccagccacaggatgggctcctcctcctcaggggaggtgtggtcccacgacagctcctggaagcacaggcccagcaggacgtgcttctctctgctgtccacgacgtgcacaccttccaggctgatggccacagaaactgatttgcgcccaccccggtgcaaaaagccttgggctggcttgtcaacctcaccgtggaagaaggcacacccatagaagggcagcttgtggcacttgaggaggtaggcgcggtagtgggtgcccagggcggcctcacacccgccgtcgctgctgacctcctgcaccttgcggtaggcgttcagcaggctctgctcacccggcccggccctggccccacggccccggagggcagcaaagagaccctggccccgcttacagaggtgggcagggaggaaggagtccagcttctccctcaggtcgcaggctgccggccagtcgggctggtaggtcacgagctgcacgcggcacaccagggcgcccagagcctcgcagtcctcaacgtcgcacaggtaccgtgcagccagcacgttgcccttggcctcctcatagagcagccgcaggacctcctcgtcggggatctggagctcccgcccctttgggaagaacacgttccttcggaactgcaggaaaggctcatccatggccacgtcgtcgtccggggcactggtgaagcgcagcagcagctccggccactggcgtcccagcttgtagggctggttcttgggtttcagctgcacctccagcagaggggagaccagccagagcgcgaagacatccagggcgatgtccggaagcttcaggacctcgcggacggcgcagtgcagctcatgggcacggagcgagggcaggttctccacagccaggggcaccaccgtgtcatctgccaggtataccagcacgtcagccgctcgggctcccacggaggacacgctgcttcggtgggaccgctcagtggggccgggctgcccgacactgccttccgtcccgtccatctcacagggtcgcagagcccgccacctgagaggcaaggctcctgcccggaatcctgcccctccaccaagcccacggaatcttgctctgtcacccaggctggagtgcagtggcgcgatttcggctcactgcaacctctgcctctctggttcaagcgattctcctgcctcagcctcctgagtagctgggattacaggcatgcgccaccacacctggctaatttttttttgtatttttaatagagacagggtttcaccatgttggtcaggctggtctcgaactcctgacctcgtgatctgcccacctcagcctcccaaatgctgggattacaggcgtgagccaccatgcctggtccaacagcctcattttaacttaattacttatttaaagactcagtctccaaatacagtcacattctgaggtgctgggggtcagagcttcaacatacgaattttgaagggatacaatcagccatagaactagctgtgtgaccttggcctctctgcacctggtttctccccagggtatgt

SEQ ID NO: 2267 - DNA, 1150 bp, artificial
  synthetic oligo
cattcaagaggtggtctgcctacctctaacagtctatgatcagatatgcaagcaaagaaatgacttaaagttggaacttatatttaaaagggaagcagatagtacaagtttggaaaatttgcagcctggcctgtggtaaagaaagaatccaagcaggctatggaacaaccacttgctagagagattagcatgactaaaaggaagcccagtgctaatatccaagacaataggaaaaagacctggaaggcatttcagtagtcttcagaacagcccttcccatcacaggccagaggcctagaaagaaagaatggtttcagtggcctgcccagcctcaggacactgcacctcacatcctggatcctctggctctagcctcagctcagaagtgcccaggtacagctcaagcggctgcttcagagaatgcaagttataagccttggtagattccacatagtatgaagccggcagatacaaagaacacaaacatgaagtaggcttggcagcttccacctagatttcagaggatgtgtggaaaaatctgggtgcctgctgcaggggcagagccacagcactgagcctctactagggcaggactgaggggaaatgtggggttggaggacccacactaccaaggaactgcctagtggagctattggaagggtgaccccaccctccagatctgagaatgatagagtcagcagtgcttttcattctcagtccaggcactggactccaacccatcaggacagccacaagcgctgcatctagcaaagccacaggggcagaactgcccacagtatagcatccacccctcataccagtgtaccctggatgtgggacatggagtcaagggagattattttagagctttaaaatctaatgactgccatatctggttctcaggcttgtgtggggaatattgcccctttcttttggctgatttctcccttttgaaatgggaatgtctacccaatgtctgtaccatcattccaccttgggagtaaataacttgtttttccatctgacaggctcataggtagaagaaacatctccacatgcaactttggactttgggctcaatacttgggacttttgagttcatgctggaaagttaagactttgggggactattggaaaagtatgattttat

SEQ ID NO: 2268 - DNA, 3050 bp, artificial
  synthetic oligo
gagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcc

SEQ ID NO: 2269 - DNA, 1000 bp, artificial
  synthetic oligo
tgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacac

SEQ ID NO: 2270 - DNA, 3400 bp, artificial
  synthetic oligo
gtgttgaccagacgcgtggagaggagagcaggccggcagctcttgagagtgccaacttcccacgggttgagctctctgggaacaggactgagagggacccaaccctaaccgcacgagccgcacactcagattggtgccatcgggcgcgcggcgtccttaagagctccctgaaaccccgcccccttcctgctctgggggcgtggtatggggcaaggaccccgccactgagcttgctattggctaagagagcagggttggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcctgtccactcttgctgccccacgccgcctcccccccagccccgccctgccccgggtaacttcccaggctcctgcctaccttggcctcttgggtcccagggacgtttgatctctcagccctggagtaggagaaggcagctttagttttcttctcctcgattaaggtagagtcctattactggttggtgggatggctaaaccagggttggggtggagggctctccctgggtacaaggaaagggattggcaagaatttctttcctacccagaagccaaacggggtacaacactctcctaacagcaggggctcaaaatgctctgggagctctgggctgcttgagcccaggggggaacgttgtgaagtgctcagtggttgtgaagtgctcagtggttgtgaagtgctcagttaccctggtaagggtggaggctggaaatgttctgtcttgagccaggagagttgaaatccgcctggggtagcccatcataggggctcatgggagtgacctaattgctctctcgggtctctaaccagagatagcatgcagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgc

SEQ ID NO: 2271 - DNA, 1100 bp, artificial
  synthetic oligo
ccgcccctcggctcctcctgctgcctcgggcctcctccccagcccggccctctgccggccccatccctgcttgggtctccctaccgctcctcctgcccccccacccctttatttctctctcccttccactcctttcctctctcggcccggctctgtttctgcggcattctgtcttggttttgtcatcatctcaagtgcagccccgttcttctccgtggtctagtttcccatctcagcctcccaggccggcctcctcccctctgtctccgtcttgctgtcttgctgctccagaggggtgccctcgtaggctctgtcactctccatctccgagctccactctctgtgtctcctcgccagtctctcggctttctgtgtcccttgggtctccctcactcgggctctctggcctgctctgagtctgggtttctgaggctgccccaaggcacttctgcggaggtttgctgtgctggataaacatggccccagcagcaggacgtgaggaattctgctgacggcgctttcctcaggggctgaggaggggcagtgtgagcctgcgggcaggggcctcagggagagggcagtgtcttctccatgcctgtgtccctgccttctgaccctctcagtcagctcaggggtgtctccccagctggaaaaaaagaacaggccccaaggggctgctcacctggcctcgcccgctccccaacaatctcccctgacacacacacacacacacacacacacacacacacacacacacgcagccgcagccgccgcagccgcagccgcagccgcagcagcagcagcagcagcagcacacacttccctctggtatctgcagcccagaaccaactaaatggaattcagtcctgtgtttctcctggcctggcctgcctagacctcaagggcagggtctctgggaagggaaacaacccagaagaccttgaagcaaagcattggaggcaaggacccgttagagatcattgcagccgtctctctgctctcagatagctccctgccctttgccatcattccatacttacaagccttaccccctgaggaaaagcttatcccctaccccctatttggaggctttatcccac

SEQ ID NO: 2272 - DNA, 1000 bp, artificial
  synthetic oligo
cagttctaggatgctcccttctcatgagagaccatgcagatgaaactctgcagagttgtgcaccacctatacaaccctgtgagatgtgcctacgacttctgtctcaactgtctctaaagatgcttgccaatccctttgcccttagaaaatggtcttgtaaatatctgctgtcctaacattccaagacttgtcattttgctttatcccatcccattgggttagacctgttagctttttgacatctgcttgggtttaacttgaggcatagagagagagcttgccccagactatatagatgggaaatggagaaaccggtatccaaagcaaggtctatcactccaaagcctatacactgtctactataggcaaggtggctggaagaatgcagctggcaagtgtctgaggttttgtattagcccacaaagggcataattatctcagacacttgtttattcattcactacattttctttaagtctctgcctcaggtgattaccttccaactctaccattcagtgatatctccaatctgtattatgttagtgaggcctctttctattgcaaatggcaggtatccaacccaaactagtctaagccaaaaggggatcttattagttcacataaactagaagtacaagggtggtctggtcaggcaatgctagatcccagctcaagtgaggtctgtccatctcttggatgcccatttttcttcgtaggcatcactgtcaggcatgctgttctcttagagctcctgaaactctaggcttatatcttctagctgatcaatccccaatgtctctttccctacacttttatcagaagttccagggagggtttgtattggcccagctggggtcacatgactttgcatatactaatcactccaaccagcatgatgaaatcctctagttggccagggttagatcatctgtcagcccttggacctgattcacacatactcacagtggtggaggggtactctcccacaaaaatgttggcg

SEQ ID NO: 2273 - DNA, 1100 bp, artificial
  synthetic oligo
tgggtgatatgttgctttctgcaacttttgtccccttcactcagcttcctgagggcaaaggcaggggccacacagacttggctccgccctgcatctcagtgcctggttccaggacaggcgctcagggttagtgtttgtgtggcagtgcatgataagtgttttatagccatatgctcatttaatacctacggcaagcctgtgaactaggtgttgctattatctgcattttatagacgaggaaagtggagaatggagaggtcataatgtttgcagtgatagagcaaagattccagatctgtctgaccttttataatcacacacaaacacacacacacacacatacacacacacacacacacacacacacacacacacacaatgggcactctggaaatattttttaaatgaatgaaggattgcaaatgttaaaaagttagacttaaatttaggtccatcagacataaaattcatattcaacctccatcgcctaagctgacatatggggagccccatgctatttttgatgtcagattatggaaagaacatgagctttggagccaagcaggcctaggccttcaatctctgtctcactgattactatgggacctcaagcaagtcacttcacatctatgaaccactgtttgctcatctgtttgtaaaatggagacgaaagtcacccctgattcttggggttcctgtcagaagtgtgactttggacaagcttaagtctgtttcctcttccagtattctctaatgtagtaatctcaatctatactgctatatcttgtttcactcattcaacctattcatctgtccatctacctgctcctcagtccatcaatccaccaattcatccatccatccacccactcatccatctatccatccattttccatccatccacccattcatgcatatatccacccatctattcatctatcctccattcattcaatctattgatatgaatcaagacctctgctatataccaggccctgtgttaggccatgagctacagagaagagtaggatactaacaaaacctgtagtctaattgttcaaatagtggtcgaggtctctatcatgacctgtggtaccac

SEQ ID NO: 2274 - DNA, 1300 bp, artificial
  synthetic oligo
ggctgcacctgccaggatatggacatgaggttgaatcctcctgccccactgaagaggggagccagaccactctgctcccaaacccagggcctttccaacaaaggtcaagggtggaggaaagccaggttgagtgggcagaggaattctgcttatagccctgacacactgcctgtggcacagcctcctacaacagactggcctgtaaggccaggtcctgcccggtctgcatgagaactgacacaaaagtacagaccgttctaagtcagagctgaggtggccctttgaaccccagatccacccacctcatgattccgttggaaaagctgaggtttaggttcaggcagagactgtcctgtagttggtaactagcaagccagggcgtctggcttatctcttagcctttagcctgcttggccctacagacttgatagtttcttcctgcttacattttagagggaagagacagaccacaattttaaaaagaatatgcaagtaaaatatgtagcatgaaagatggtggcaagggttatggaaaagaagaaagtagtggagggggaatgagggtgctagggtttgtgattttagatggcatcatcaggggaggcctccttaacaagggagcactggagcaaagtctgagggaggtgagtgagtgcacttgctctctctacagtgtactgtgaggacacccaagacagagcccgaacctccagactgcccccaacagggccatggtcagagggcctcctgggaggtttgcctatggattttggcctggccacagggacaggaataagcatatcttctgaaactgaggctggacacagaaccaaaggcctatgacaccctaggtcaggtaatattaataacaacagtaataataataataatagcaccattttatctgcattgagcacataccatatgccaggcactgtttctagcacgttacgtgtgttatctatcttattccattcacacaatgaccctatgaaaacagtgctgttctaatgcccatttcatagatgagaaaacaaagtctcagagtggttacagaacttgcccaaggtcacaaagccaatgagcagcagagttgtgctttgatcctaggtctttggactccagagcccatgtttcatagacagaagcaggttttagccatctgggctggaacgtttgtctagaaacagagggtagatgagatgatctcttgggttctctgctgtggtcataagggccaggcagctcagaggcagttgaaagtgatgtctaatatggaagccaacctgggataggattg

SEQ ID NO: 2275 - DNA, 1900 bp, artificial
  synthetic oligo
cccagcctcaaggagacagagtagctgggcaagcaggctgggctctggcctggaggaaggccttgggcctggtgctgccaactgcagaagggctgtctggggagcccctaccaacacatcccacataatggggctcacctaggcatcacatcctcttttttctccctttactcccgagaggagacagtaagcagtggaagaggagtgcctaaaaagaaacacgtgtcctcagcattccaactacagctccctgcctgcccactcccctgcacctccccctcacttccccaccagcccctgcccgtgagcagccttgtccttggtgctgccacctctggctctccccatacctccaatttgtttccagaggccttgaaggccaatctttcttcatgacagagcctcgtcctttagcctctcattatctctctctttccctggctcctgggagccccaggccagggagggagagtgatggggtggggacacaagaacatgtggctcccagtcctgactctgccacagattccctgcatgccattgggtcagtcccttctcttttctggcctctttccctatctgtgcaatgagccaatctccaagggccttgtcagccttgcgtttctcaccaggcagcagagactcattgccctaatggagagaagcagaatgaactccagctcgaggtcaagagcagacctggaggcagagaggaggccaactggactgtgttcaaaatggagggctgattcaggaataacggcataaagaggctgggatctgctcaccctgggccccttttcctgtgactgctccctcaatatgcgttcaacaagtcactatggagcagtagctctggaccaggcaatgagttaggtgcagcaaacccttggttcctcactttggccttacaattccagccatagcttctacttctcttccctacagacatggaggaatttggggcctgatcatccaaggccacacagagaattaaaaccgaaaactgggctcaaattctcatctcctaaccaccactacctccccacaccttgtcaaaatttttctccctagaatcctagactcactgtctgatccggaaggcactttaatcatgcctaagagcctggagatttataaaggaagctgtaactgggaagaatccggcctgctgggaagctgcttctcccaggtacccacaagcaagatacatggcttcactcctctgtgcccccacagtatttcgtttccccatgtaggcacatcagtgggtgcaggttgccccctttcatcatttactcacatgcttgtctctggcactgagcagagcctgtgtctcctctatctccgtatctcccaggcctgggccaggcagacatggggaagcaattcagtgggtgcccgtggtgtggaattgaccatgttgctcctgaaacacagtttctttttctctctttcttttttctttctttcttttctttctttctttctttctttctttctttctttctttctttctttctttctttgtctttttctttctctctctttctttcttctttctttctcttaccctctctctctttctccccttccttccttccttccttgcttccttccttttttgagacagggtcttgctctattaccccgagtggagtggagtggtgccatcttggctcattgcatcgttgacctcccgagctcaagtgatcctcccacctcagcctcccacttttcgggactacaggcacacaccaccacagccaggtaactttgtatttttagtagacagggttttaccatgttgcccaggctggtcttgaactcctggcctcaagcaatctacctgcctcagcctcccaaagtgctgggattccaggcgtgagccactgcgccc

SEQ ID NO: 2276 - DNA, 2250 bp, artificial
  synthetic oligo
aattttaaagcaagttttagacaccgttctttaaaaagtttcctgagtgtttctcatcatctgggtaagctctaggccgcttggccagctctctgctccccactctttgctaccctatggcaactcaaatatacatatatctacatcttccctcccacttcattatgctgaataatttgaccttctctagcccctgcccttatgcagctcccagactgcctttctacctttcgaaattcactatcatgctctacttaacactggaccacttcctttctctctcaccctttctctttgccctagaggggaaggcagcggtgtagagatgtatcccctatccccaccccgtgtgaattttgtctcaaccccttggatgctagaagtgactttagttgtttggattaaaactgtttttttctcttccatcatatattcacatgtgtgtgcagccatgaagcatttagcgcatctagcgcagcacctggcctgtgaaaggagacccttgtgattaaccctccccccatcttacccttcaggttctgaggccacagactggaaagagactgatccctgtcctccacctcaccccacccaagagctcaccgtccaaagagggagaggaagagccagacacccaaacctgtgctgccaacaggagtagatagaggaggtgggaaagccatctaaccaggggctagtaggaaatcgctcaatagaaagtgacatttcagctgtgtctttaaggatgaatgagggcaatgggagtggcatgcaaaggacagaggtgagaagcatcagatagtccaccatggcagaagagagagtggatatgggtgtggggtcaggggaggagctagattggggcccactgtgactggccttgaaagccaggctaaagaatttggacttaatcctgtcggcaatactgagccatcagaggttttgtaagtaggggagtaacatgatcagagctgtgtttaaggaagattaattaaaaataatgtatggtgtgtttaattcatggctagccctgggctttggagaagacgggagatgaagaaaacaaggccccaatgagcaggcaattcacaaaataatggccaataaacatatgaaaagatgttcaaccccactagaatgcaaagaaatgcaaattaaagcaacaatgagataccatatttggcctatcaaattagcagggattaaaaatgataacacttgatgctgcggagggttttgtgaggcggtcccttgctcactgcggggaggggtgcgggggagggggtcgggctgcaaatcacttcggccgttggaagggccgtttgacaagaaataagaaaagctttttagaagtgcacatagtgtgaccgagaaatcccacttctaggtatttgtcctaaagaaattgtggatgtgagtaaaaatttatgccccaaatatctccctgccctgggtgttatttataaaagcaaataggtggatcgaataggggaagtgttaaaattgtgtggctgcgacctcggagactggaccttaacatttctgaatcctcaaacgctggaggcagcagacaaaaccgctatttcttttttaagctgccggtggtgtgttgcccgggtctctaaggggagcagctaaaatttgtcctgggggcagacggtgcctttgttccgctagggacccacaggcgaggcctcttggtcatgcagatgtacctcaagtacctattcattgtcttggggaggccctgactccatatgcagatgcggtaagcagcgatgttaagcattctgtttaataatgtaaaaggccttcttcattgtgggctgggcggcatctctgcagaatctcttgtgatgttaaatgattttcagcttcctttggccaggctttgcgacagcatgggggcaggtggggaggggggtgggggggtcgatgacagccctggcatgggaatagaaaggacggaagaaaagaagctcgggtttgaggaggacagggtcccagcaacgaggcggcagcctggattaaagaccatgaccgccagcagtgagccctgggaaagggcagggactcagagcaaatgaggccgctatcgattgtaattccccatgccagtattaccccaagagaagttctgtacaggagaggattttaggtgggccatggaggaaaaagaaattgaatacttggggccgggtgcggtggctcacgcctgaaatcctagcactttgggagactgaggtgggt

SEQ ID NO: 2277 - DNA, 1600 bp, artificial
  synthetic oligo
catggcacatatatacatatgtaacaaacctgcacgttgtacgttgtgcacatgtaccctagaacttaaagtataatttaaaaaaaaaagaaagaaagaaagaaaaagaaaaatggacactctagttctggaagggaggaccgcacaaaaacttgccaatcaactgacgtctctctaatggtcgagggaagccgactaaggtgtctttgagggggcggtgatggtagggaatttagagggtggagagatttgaagaaaagttaggagagttggtgctgagcctggatcaagcaggaaggagaatatgcacacctgaaagaaagaaggccaccgacttgcatcggcacccaccctgtgccccgccattcagacccattttctctttccggcttcaccaccgcagagtgtgttccactagttccatttcacagaccaagaaactgaggctccgagaaaaatgaagtgaactgcccgaactgccccgggtcacgcagctgagcccggctgccagcacaagccagtgggactcttttcacgcctggggctctgaagagctgcttgggaaccatcaattactgaatcgaagcaattgagggagcccggcgcggcctcgccgcctgcccgggcggctgctcgagcccctcctcttctgccggctgaggcgtttagtcatttagactttgaaggcagcctattctcaccagcagctttcctgcccgcacatttgcatttggagcctttcatctgatctctcggaattaaaggctttgtctccgattaaaagaattccaggccggaggagcccggagagggaggggagggggctccaggccccaggccttccttcccagagctcctggcctcgaaccggctccgccggctccagcgcgggaggcggggcggcccggaaggcctggtttggccggataaagcgaggaccgtctcagggatcctactctactctttaaccctgccgacttccctggccaccccgggcggagcctcccagcagcctaggatgcagttggtccagtaccaggagctggctcaggcagcctcccaatcccgactctaatgtttattggctgtgtgctattgcgcagccgggctctcccctcggagcctcagtttcctcctctacaaaatgggagcaagggaatctgtaaaagttgggctccacctgcccatggcagaggaaagggtttgctattaagaggcagggaaagaaatgcaaactccagatgtgtccctatgtccctttggacaaaagctttctcctgtgtgggcctcaggctcccccttgtaaaacgggctgttgggtttggagggctctcctccaactcagaaatattatgggatgctgagtctccaggacccattcagtcagctccttccctcttgccctgaccccagcctggacttggtcccctcccccatcattataatacttttgtcccagttccctaggccaccctggctgcacattagattaacttagggagatttatgaaaatatcaatgtcaagccccagagatccagatttaattgttttggggtggggccagggccaagtttttcaaagctccccaggtgattcta

SEQ ID NO: 2278 - DNA, 1000 bp, artificial
  synthetic oligo
ttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccag

SEQ ID NO: 2279 - DNA, 1000 bp, artificial
  synthetic oligo
caattcctccatggcttatcctagtctcgttgctatggcatctcaaagacaggctaaaatacagaggtgggtcaatagctataatatgaggcctgcccaatggcggtgcttttcaggggcatgctttcttggcgggtggtggggggccagaatggtatgtgtcactttcttggttcttattgagcataggccctagggagagcaaactttcctgagtttttccaagaagcctctgcttttgttgagatgattatacctacttatcagacccttactaccttatggttggcaacagcagcaatgtagtttagcagagtgtctcccaaccttttccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttgtgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacagtggtgggtggagatgtgtagaccaaaaacagcagctatgagcaattaggtgatggtagaacacaaaga

SEQ ID NO: 2280 - DNA, 1450 bp, artificial
  synthetic oligo
ttgctcctttgaagtttctttggggtccagcttatcacagccccgtttgatgagctcacggccgtctcttggactgcccgtccaggcctctctcgcctgatccatttctcctcactgcagcaggccctcttccacagacccctccctcacctcccagggcaggcaggtgcttctctcgtctgtgcaacccacagcaccccatgcaggtgtctgcttttacacctacttccaacactggactgtgagtttcttgagggtgggaatcacgtcaaccttcaatgtctacaaatgaaattggcaggccctttgtgctccttggcaacccttccttctttattgcttactctgaggctgccaagcttctgcttgttggttgatgaattgtaactgggaaatcacgagtgctggatgttcagggtttatctgctagcctaattatcttcttcttgctctttctttgttcactgatgtttatgttatacttgtccatttggctcaagagagctccagctgggccagcgtgctctgtctttgggagcaaagggtggccaatctgggtcagtctatcttgcctgaggcatcaagagacctggtctccctcacaggttcaacagacatttacttgagtgcctgctctgcaccagaccctgacccagatgttagggagacagaggtagaaaactgtctggccctgtctgcctctggttcctgcatcaccttgagccctttccagatctcctccattcacccatctgaaagtggaggggagcggagacctgatctgtaaggggcgttggagctcttgatactgtggatctcgtctggcctgggcactctaagcccctccatatctctgctttccctgagcagagccaagcctgcctctcttacctccctccctcctcccgtgcaaattctgagcagatacgctctgatacatctcaccttctatgtggtcaagcagccccaagaagcagctggagaaccccagctagcccaaggggaagaaaagaaagaggaggaagaggaaggtgtcgcatgtcagatgaccatctagtgcacacgggggagtgaaagcacaccctgacataccagaaaagttccccaagctcagctctgaagagtcacattggtcagtctaatgcgggaagcccaaagcagagtgggggtggggagatgacagagttccaacaatctccctggaaaagggaccaatgcccccttgcacttatagaacccttgataccatttttgtatctcattttcccagcaaccccttcagttatgtttaacagatgtttttgactaccttctatattcaaggccttctgctgggagtactgggcttttcctgtaggacacattgcaacttcaagtgtacagacattttatcttaattttattttattatttatttatttacttattttgtagagatggcatctcgtta

SEQ ID NO: 2281 - DNA, 1900 bp, artificial
  synthetic oligo
tctcttcaaatcccttcttaccttttcacctgtcctggactttcatcttgatatcctgaagttccttcccccatcataaccatgcaggggtggagtggaggagataggggtttgtgggccagggacaaggacttagagctttctgttaatccctgttctagggttgagttctttactggtgatggtagaaggtcaagtgtgaggtcacagtaatttcagggcctagagactgagagaacaatagtcttgtgtaggaggcattgacaggacagcgggcctcatatgctgccttcttctttggtcccctgtaagagaaagcacctccctcaccctgctccaacgtcctttctgtccatcctgctacctcgtctttacttctggtggccccagctcagagcaagcctggggacccattgaacatctccctgcaactccctcttggaagtggggtggggtggagtgggcagaggacaggctaaaactggcgatataagggcacaagatcgggtgcctgagctttctggtggcccacgtcctctgcccccgcccttagagccaacagttccctagagattgggggagctggggctgagcctgggggcgccgctgcctctgttcctttaagtagccgctgtttagcattcctgccgccgccgctgccgctgccgctgcctgcctctgcgcgctgattggctggaatcaactgagaagggagccagggagagatgctcttgactccactcagatccatcctggggaccagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaagg

SEQ ID NO: 2282 - DNA, 1000 bp, artificial
  synthetic oligo
ccaaaactaggaacatttcccttgagaactggaacaaacaaggacgcccacactcaccacttctattcaacatagtactgtggtgtagtttgaatgtccctgcccaaatctcatgttgacttgtaatctccagtgttggagatagggcctgctggaagatgtttggatcatgggggcatatctctcatgaatggcttagcccatccccttggtgatgagtgaatgagttctcacgaaatctggttttgtagaagtgggtggcactttccctcccaccctcactctctttcttctgcttttgccgggtgaaatgtctgctcccgcttcaccttctgccatgagaaaaagctttctgaggccttaccagaagcagatgacagcactatgtttcctgtacagcctacagaaccatgaaccaattaaaccttttttcttataaattaaaacagtctcaagtatttatagcaaacaagaatggcctaatacgtactatatatcctagccagaccgatcaggcaagagaaagaaattaaaagcatccaaataggaaaagaagaagtcaaactatctcccttcactgacattatgattctataactagaaagcactaaagcctccaaaaaaaaaaaaggctcttagaactaataaatgacttcagtaaaatttcaggatacaaaataaatgtagagggagatagagcaagatggccaaatggaagtctccactgatcattctccctgcaggagcaccaaacttgacaactatctgcacaaaaaaagcaattttgtaggaaccaaaaatcaggtgagtggtcacagtgcctggtcttaacttcatataactgaaagaggcactgaagagggtaggaaagacagtcttgaattgcccacaccatcccttccccattcacagccacataatgggaagaatctgtgcgtttgggggatagagagtgcaatgattgtgagactctgcatcgcaactcagtgccgccctttca

SEQ ID NO: 2283 - DNA, 1150 bp, artificial
  synthetic oligo
cagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtgga

SEQ ID NO: 2284 - DNA, 1000 bp, artificial
  synthetic oligo
cctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactaga

SEQ ID NO: 2285 - DNA, 1400 bp, artificial
  synthetic oligo
tgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctc

SEQ ID NO: 2286 - DNA, 1200 bp, artificial
  synthetic oligo
ttaaaatatttttttaaaaagccgttacactaaatctagctttttaccaccacctctccctgctaatcagtggggaaaaagaaagggaactaccagtaatgaacttgctatgtgatagacattgctttaggtgctttctccgacactgccttatttcaaccacacaactcacttgtgacgtgcggggttatctgcatggatgattcagaaaggggacaggccttcgccagacacggcaattaaaggtgggcgtgaggattgatcccacggctgtctgattctccttttcctactcatgaacactgtcttcagtttcttttaagtgaataagctatgatatattcatgcagttaaaaacaaatgaactaaagctacacatttgaacatggatgcatctagaaaagccaacgatcacatggtagaagaagcaagttacagaatgccatgtatagtttgatgccacttacataaactctaaaaaccaccacaaaatcaataccatgttgttttggataacactgttggttctcgaggtttaaaacagggacaggagataccacaaattcataaaagcagttgcttctcgggcaagaaggaggatggggttggggaggaggccataggaacttcttgatcttaaggaaaagctgtaaggcagccttggtacagcacatcagtcactttatggcagagaatggtgaacaattcctctccccacctgccctcagctctcccctttgccctcttctcccctccctgtcgccctcttctcattaccagtgggcaaggctgcccgtaatttgcttctcccaagcagtttcctctttctctctctcccctagttggaaagcaggggtggagggagagagagaaagaagagagaagagagaagagagagagagagaaaagcaagtgctagcccatggtcttggggccagttttcagccagactgccccaccaaagcctccaggctagggcctggaattaaatttacacccacatgaggcatacttgcaaggcatcaaggcccttcccctcctgtggacagatgtgactctccttgctctaaacagcttgtcacctgcagggttcaggccagagggaactgagggcctggcagaggtcaggagcagtgccagtggagggagcaggaaggattccagaaaccaggccagttaggatgagcaggacttggccag

SEQ ID NO: 2287 - DNA, 5450 bp, artificial
  synthetic oligo
cctgtagtccaagctactcaggaggtccaagctgaggtgggaggatggcttgagcctgggaggtcaaggctgcagtgagtcgggttcgtgacactgcccaccagcctgggagacagagggagaccctgtctcaaaagagacttgacaactaaatgcaaagtatgatgtttggttggaaagagaattttgttagaaagcagctatgagggatactatgggaccatggggaaaatcggagaatgtttcatgtgatcatacagtagaaaattgtgtggtctccatgttacatttcctgagtgtcatggtggcattaaggttttgtgggagcccatgcttccttgcaggcgatacatgctgcagtatttaccgatgatggatctaaatgattccaacggatctcaaatgattccacaaaacaataaaaaaaaaaaatacacccacacgctcagaaaaagatgggggcgcggcatggagggagggctgaagcaaatgtgagaaaatggtaacaactggaggatccagtagaagaatatacgtatgggtgctccttgtgctttccctgcaactctcctgtggctccaaaatttaaacaaatgcaatctgggatgaagggcgtattatggaccattttattccagtcagtttgaaaacaacgaaaaagtcaccaattgctaggaaaccaaatccgccaagactgacacaagaaggaacagccaacctgaaccattccagaatcattacagaaagatatgagtagtcaaagtctttctactaataaactccaggattccccaccatattctgacaaacatcctaggaatacatatcttccatttgacacaaactcgtgcagaaaattgaaagggagcaacaatcctccactcactgtatgagcttggcataacctcgataccaaatcctgcaaggacacttagagaaatattgcagataaatcacaggctcatgacatagaagcaaaaatcagaaccagaatcttagcacacagaagcctacaggatataaaaggaaaacgcctaatatggtatgactaatattggcttcatcccagaaatacaaacttaatttcccttcagaaaatacagtgctataattctccacattaacagatttggggagaaagatacactttttgtagtcacgaaaagtattgactaaatgtcaatatcaattcaagatgtattgctgacaattcttttttttttttctaaaaagtcaggactattggactataactacacacagttgtatgggattttgtaaattcatactgctgtggaaacaccagcacggtatatatagatatagagcatcggcatcccccccagtttccctcacgccctctggtagtgaactcctagtcttaaccctcagaccttggcaaccaccaatctgttttctgttgctacagatttgccttttccagaatgtcatataaatggaatcacacggtatatgcatgtgcatttggcttccttcagagaaagacattctgatcacaattctctgaaggtgcaatgtacagtttcataacctcagtagtagttacctggcttgatcaccttacaactgtttgtcagagggccggcttctgagttctctctgtaagtgtgtgtgtatgcgtgggtgtgtgtgagagagagtatgtgtgtgtgtgtgtgtattatgtttcaaacatataattttacatttagctgcctctaacttttatatcttggtgagggttattaactgggaattattagccctgtaaaagaaagtgagtgattattggaaaagtcagcacagtgattacctctggggtgtgcaaagggggaggtagtgatcgggttggggcaaacaggagggttccaaaaccctgccaaccttctgttcctcgctctgcatggtagtgacctggacttcaacattgcacaaccacatgggcgccgttcacgctggatcatgagaacggagcaccctggaatcccacagatagagtttgcatggccaccctggcggccatagcctatgcggccgtacctggcaaacactggtgttggcctcatccttcaaggaaagggatgatgagaaaatgtgtgggggaaaagaggagttcttggggtggaggttaaggacagatgtgcatgaggttgtccaagttcatccaggagtgtgttccaggcaggctaaagttcatggctgttactcaccatgaccactgtgatcccatgattgccatctcacatccctgcgtatggtgccctgggcctcggccacagcctggaaggccactcttggggactctggctggcgggcgtgtgaggagactcacacacctttggccctagttggagtctgaagaggagatggtcttttctgcccacagagtaagaggtctcatctggaaatgtacctgtggcagccctggcgccgggtgtaggtgggattctgctcagggctctgccactgtggctgcatcaagggcaggcactcagctcgccagacctccggagcccgtctgagctgagtggcaggacaaggcaggagagggtctaaggctctccagcccagaccccacaatcctcttggtgggagagcaggcttgagggaaaagcaaaagggggtcactgaataaggggaggtgctcaacctcttcctctccactggggcccagatggattgcgctaatccgaggaacctcggattctgcacttatatcccctagaactggaaggctccgcctgaccatggcctggggtgtacatgttacagcctcagtattgtgtgggaggtggtctgaatatggaaccgaggtggtgtgctgagaggcggggctggcaaatccagccaccgggagatgggttcacgccttccatgactctgtccacgggtttctccccttccacactctgtcgaccacggcccatgccccccagggcagtgataggggtggagttctcaccccaccagaacctgcctagatgtctccggtggcaaaaacccaagctggagagtccctgacacacgtcttcccccagacaccagcccactgtgttatccccccaagaaacaaacacctgtgtcagggtcaaagccttggcccaaggaatcaagccaaccctctcaggcgaggggtttgatgcggatggggtaggtccccaccaccatttgtttacgtctctgaggcctgtgattggccctccatgtgcgtgatggtcccaccccatcccggcagtgagacacagtgagagtatgtgggaaggcaggtaccgagcctgactagctgtcccagggcagtccctctttctggctttccacctgcactgttcccaccctgcccatgtcaagtcacagcaccctcccatgggagatccccgcttcctagatgaaacaccaaccagcaactctgaggcattatcactgcacccacacacgggagtgctgagacatcccatccatcctgcagaggatcaggagcctactgtggtgcctccagcattctgagagcccgacacccatccctgtgtttggggatgtcccatttgtcccagtctgtgccctcctaggtgttagaattgaacaccacctcttgtcaaaggtagatctcagccctgcttttgcgcattcgatccttcacggatccttcaccactgcctccactctgtgaatcatctctttcttgctcaagggagagcaccctcaattaatttgattcccaagcaggtgcatgcaggggcatgctcatgcaggcgcgcgcacacacacacacacacacacacacacacacacacacacacactaaccttgaatggtatctgcatttctactgtctttgtctattcaacacccagtctcttggcgatgggagcagggagaacctacacacacctcctcactggaatcggaatctgtgcccgaatctggggcccacccagtcgaggattccggctgaaggtagcgggcgatcccaactgtcggggagggtgaaggcagaacagggagctcgaggaaatctcatgtgacctcgagaggcaatctggaagactgagtagggacatggaaatatcacatccacaaaaacctgcggccttgggggtggtgaaatgatatttcatggggaccatccaagaacagccaggcctagcatcgacacttgccctggaaagcagctggccattttcaaatcaagggtatggagccgaccagccgcagaaggggctgttggctgcctataggacgccaaggatgtggaagccaccttccgtgtagctcccagcccacagtttctaccaggttggcccgcaggcatcagaacagactcagtgccccggcctccaaccaagagatgaacccgcccttttcttcagcgttccttgtaccttccctttggctccgccacccaccaggaggtggcttctgcctccacctggctactaaggaggagacctgaccggatttggtaactgaggttcaaaggtgagggctaagaggaactgaggatgccatgcaggttactggcccagatgacctgaccgtgtgcatggtggcaccggagggacataacagctccagaaagaggacggggctccattgtgttcctcaacagcacagaaataatcgtgcaggaaaggccacccacatgaagccactgggagggcaaagatgcttatgatggaaagaacggtgacagggcagaactgggacagtgaaccgcaagaggaaaggtgagagagacaggggttctagaaggagtccatcagttcctgctgaaggagagggagaaaagcactgaagaaggggacctgtgacaccccaaagtgggaggagaagaggagggaccatgagcagggtgtgtaggagaaaggcaggaaatgctgctgtggccgggcagggcccccacagcacctagacccagggcactgtggtgagcccgagtgcagggctgctgctcagaggccggcccaggcgccccgcagggagagggctcaccacagagcgccaggggaactgttcttccagcgccagggaacggagcaacacccggcacaccccaacactcccaacaatcacagagatggcagaccacagaccacagaatatgagaacgactttatttcaaattgctttgaactgcgttgggaagtgtgcaaatgcagaggaagagaggaagccctggctgaacaggatatggagggaacccgcttggctgcagctccggagctccaaaggtggcagctgttcatcttgtaggaagatgctggctccaacctgtgaaacagagtaggctcagggacgggccctcagccagggccagcccacagccctcctaaggtaccatgattgtggaaaggggcatggtgtgtgcaacactcacttcaaaggtcctggaacttgtcagtgaggaactgcatggccgctgaaagagagaggcagaaatgggcactccagac

SEQ ID NO: 2288 - DNA, 1100 bp, artificial
  synthetic oligo
ctatgataactctaagccttccacacactataaaaactaataatggaccttcctatcttagtgctcgatttacatatgcattgcaactttggcacatgcaacataaaactgatattccttataactcaaccagtcaggccattgttaaacgagctcatcaaactcttaaagtatatcttaatttaaaaagggcgggggggaatatggggctctcttctagagaacaggaccagtcgttggagaaccaaccaacaatgatggtgatgactcggaaggcacctgacatcacctggggacagctaaagaaattgaatcaacaagcatctatccagcttgccgccgtggaagcccctgcaactgcagacaatcggtttcttacatatctggtggcaattggggaaacttctgagaaagtaagacagacatggatgttggggtggcaggtaattcttgtcctttgctaagtgggatcagcttaaggacatgtttattggagtcatgttctaaatccccctgtttttaatgttattacatggtgggatgctgacccgcctttgtcatctaatgatacttcttgggcaggaggccgatggatgcctctgtcttaccccgtaactgaaaatttgggatggattcaacttaattactcctcgattttattgtctagtaatccccctctttgtttttccacaatagcacatgataagtgtgttactctcatccctcaggagtatctttactatcagcctaaaagggatgctaagcttgcaaacttgacctttatttctactattaccactaatcttactgaggtctctaatgaagctacacaagtgcctgatcttcctatatgccgtccgagtagggactggcgataaaagtttgaggccgtccagtggtcgccgtgcagacagcctgctccacgtcaagggcctctgtttgataatggcaccttacttgattggggtccccgtggtaatcttatgtctgcaaatcagactattggacttgggagtccctccagtagtcctattacctagtcagagtatgggctttcaggaccagtattacaagtgagagggaaacaagctttaagccct

SEQ ID NO: 2289 - DNA, 13100 bp, artificial
  synthetic oligo
ttcatggctggtactcaccatgaccactatgatcctatgactgccatctcacatccccgtgtgcgatgccctgggcctccgccacagcctggaaggccaccctaggggactctggctggtgggcgtgtgcagagactcacacaccttcggctctagctggagtctgaagaggagatgctcttttctgcccacagagtaagaggtctcatctggaaatgtacctgtggcagccctggcgccgggtgtaggtgggattctgctcagggctctgccactgtggctgcatcaagggcaggcactcagctcgccagacctccggagcctgtctgagctgagtggcaggacaaggcaggagggggtctaaggctctccaggcgggaccccacattcctcttggtgggagagcaggattgaaggaaaagacaaagcgggacactgaatgaggggaagggctcgacctcctcctctccactggggcccaggtggattcctctaatccgaggagtctcggattctgcacctatttcccctagaactggaaggctccacccgcccatggcctggggtgtacatgttacagcctcattattgtgcgggaggtggtctgaatatggaaccgaggtggtgtgctgagaggcggggctggcaaatgcagccaccgggagatgggttcacgccttccacgactccgtccacgggcttctccccttccacaccctgttgaccatggcccatgccccccggggcagtgcctggggctagagttctcacgccaccagaacctgcctagatgtctccggtggcaaaaacccaagctggagagtccctgacgcacgtcttcccccagacaccagcccactgtgttatccccccaagaaacaaccacctgtgtcagggtcaaagccttggcccgaggaatcaagccaaccctctcagggaaggtgttggattccgatggggtaggtccccaccagcgttcgtttccaggtctgaggcctgtgattggcccaccacgtgcgtgatggtccccctcactgagctcacaccatgggcccacagggagacgcacagggagtatgggggaaggcagacaccgggcccgaccagctgtcccagggcagtccctctttcccactttccaccctctctgtgggcatcctgcccgtccatgtcttggttagcgggtgtcgtggcaccctcccacgggagctccccacttctagatgaggcaccaaccagcgactctgaggtattaccactgcacccacacatgggagtgctgagacatcccatccatcccgcggaggatcgggagcctactgtggcacctccagcattctgagagccccgacacctgtccctgtgtttggggatgtccccttcgtcccactccacagccttctaggtgttagaattgaacaacacctcctgtgaaagggtagatcccagccccgctttagcgaattcgatccttcatggatccttcaccactgcttccactccgtgaatcagcccattctccctcaacggagagcacccccgattaatttgattcccaagcgggtgcttgcaggggcgtgcacacacacatacacacgctaaccttgaatggtatctgtatttctcctgtccttgttcgacaccctgtctctcggcgatgggagctggcagaacctacacacacctcctcactggaatcggaatctgtgcccaaatctgggacctgcccagcccaggattctggctgaaggaagcgggcgatcccaactgtcagggagggtgaaggcagaacagggagctctaggaaatctcgtgtgacctcgagaggcggtcgggaagactgaccagggacacagaaataatcacgtccacaaaaacctgttggccttgggggtggtgaaacggtatttcacgggaaccatccaagaacagccaggcctagcatccacacttgccctggaaaccagctggccattttcaaatcaatggtatggagcccaccggctgcagaaggggctgttggctgcgtataggacaccaaggatgtggaagccgccttccgcgtagctaccggcgggcggtttccaccaggttggcccgcaggcaccagaacagactcagtgcccccacctccaaccgagagactgtcttgcccttttcttccgcactccaggtatcttccctttggctcagcttcccaccaggatgtggtttctgtctccacctggctactgaagctaaggaggagatctgacagaatttggtaactaaggttcaaaggtgagggctaagaggaactgaggatgccaagcgggtttttgccccagatgacctgaccctgtgcatggtggcaccggagggacataacggctcaaggaagaggactgggcccctgaggggcggggaggatgagctccgtcttgttcctcaacagcatggaaataaccatgcaggaaaggccactggcatcaagccactggggagagcaaggatgctcacgatggaaaggatggtgagagggcagaacagaaacagtgaaccgcaggaggaaaggtgagagagacgggttctggaaggaggccatcagttcctgctgaaggggagggagaatagcgctgaagaaggggaactgtgagaccccaaagtgggaagagaagaggagggaccgtgagcaaggcgtgtaggagaaaggcaggaaatgctgctgtggccgggcagggcccccacacacctagacccagagcactgtggtgagcccgagtgcagggctgctgctcagaggccggcccaggtgccccgcagggagagggcccaccacagagcaccaggggaactgttcttcaaccgccagtgaaccgggcaacacgctgcaacccccaacactcccaacaatcgcagagagggcagaccacagaccacagaatatgagaacgactttatttcaaattgctttgaactgcgttgggaagggggcaaatgcagcggaagagaggaagccctggctgaacaggatatggagggaacccgcttggctgcagctccggagctccaaaggtggcagctgttcatcttgtaggaagatgctggctccaacctgtgaaacagagtaggctcagggacgggccctcagccagggccagcccacagccctcctaaggtaccatgattgtggaaaggggcatggtgtgtgcaacactcacttcaaaggtcctggaacttgtcagtgaggaactgcatggccgctgaaagagagaggcagaaatggacactccagacccagggaaacagaaacccacgccctgccccggtggggaaccacctagccctgcaaccagaaaccccaccagccctgggactgactcacccacccgtcacctgaattaaatgtggaaatgccttctaagcgggaaagtggttctcaggtgctgggccatcccagtaccgtacagaacgtatttcaaagacagataagccagccagcaagcaaacaccatacaagtcataccaggcagtagttaaaggggaaacacaggtggtatctctaaccgccctaagagaaggagagttctgggactcgtggactaagtgtacacggagttcagacgacacattgctgtctgtgcacacccctagctggaaaggcacagaaggctccagggccaggtctgcttgattctcctccccagaggaaagtcagtcccagtgatgctgcccatacctgcagcccaccaccgcccccaacaccagcagaaagacaccgctgtccatccctgccccagccagggctccctcatacctagctgctgtgtaaggtcctcaatttccctctgcagccagatgcactagaccagcggacaccggaggaagataaatggttggtcaattctgtgctcctctctccccagcctccctgcagcccccatagcctgcagcccagtggcgaggtgggttggcagggaaccctcaatggaaacgaggcaccctctctccgtggggtgcagaaggtggagatgtgcggagtgcggtggggagggagggggcggacgcagaaatcagtttaacctggacacggatcccaccatctactgtggacctctatttctaggagccacacaaagcattacccgaggacagccctgggctcccgggggctgctgctgcctttccggtcttgggggatggacaggcggctgctggttacctgaaagagaacacaaaatccagcttccaagcctcccagtgaggtggaaagggcctagtggtgtctaatgtgaggcagcatcaccctctgctggtacacgttgcccctgctctgcccagcaactccaaccccgctctgggactgccttcactgttccccagtgtaagctcatgtgcacctgtggccccctagcattgtgactccaggttggactccagcagtgcggcagccacagccaggccctgggagggcccatgtggctgagcaggacttaacagaaaagggctcagtactgccgaaagtctccttccagagttgggagtttggggcgctgctccaaatcgccccccaccacacaaaccccactcagagaggacgatgtggcttaaagccagcccagtcaacaccccgtttccccgtgggacagctgcctgggtgggcagggaagtctgggaataaggctgagcccccagaagcgacagggccagaggtttccctcccgacccctctcccctccacccctatcaaacccacaagactcaccggagggtgcatggcgtctgggcacgaggcctcccgggctgtaggccgagggctctgaagttcccggaagttggggagctctgatgttggggtcgctactgctgaattctccacgacgcacagacaggcgaggcagtcctggcctgtgggtgggaagctaaaacagaaacttctgagtcgggctggcgatgggggccggcggtgagtacacgtggggaggggttgtggtaaggtggagactcctgagcctaatctcattagcactttctccctcagtcagcctcaggccaggaggcagaggccagccagggaaaacactggggatactgagatagcccggggccgcctgccaggtgggttgggcaacagctagggaaggaggaatcaggaagttgatgagcctagatgccccagctttgcagcccacactttaaggcatcacccgatccaaaccagctgccagccctgccttccaccccagctcctctctgcgggcggaggcaggacccctgcagagcgtccagaggcatggccatcacacaagaagtgctccctttaacgtgtgcccttatgaggaagacacccatcgggcattctagtgtccctgggctcccgatgacaaccctcgagcaagggacagaggaggcatgggtaaacaggtgtgtgctggaagagaggaggtgtggggggaggagggtaaagagggagaggagggcgagaagggcctactcacttgggctcttgggacctcatctctatttgggtcattatcttctctggccgcagcctgggactccctggtcttcctccctgctggtttcttcccagggctgctgtgcttaggcttttggggtttcttggacatcccctgtggccgcacaccagagaatggcgggaaggtggccggctccgggggagcggctgagagtctctctccgcaggcaggaaagcctctccccagggccagttgagaggcaccccctagggacttcttccccccggccatcttcctcctcgaaaggccctggggcagggcccctgcagcagcagctcctgagcagctgggcctgacctccacctttccccaggccctgctctgcattttcttctggggagagtcctccagctctcccacagccggcctctctgcgactggagtgagtccgcggggagcagaggtcaggaaacggcccggcacaggcaggtaactctccttgcagtggaagcttgcctgtctggatgtgtctgctcgcttcttggggctgccgggcttggcctggcttccttcgttgcggcaaatgcctaccttcatcagtggtaagtcgctgctctcatctgcggaatcagagtcgtgggtaggcagcctggtggggcctttcgcagagggctgctggggatccacgcggaggctccatctgctcttcgagcccctttccgggttcttccaggcccgcactggcccaggaccgcagaggtggagacggccggcagaggcctgctgccattttccagggctgtggcccagcacgtctctcccactgggaccgacctccgcatctgcccaattctcagccgacccttcggcagcggcaccttctgggaacgggtgtccctggacgctgggcggcggcacgatggcggctggttcgtcagccaggtagaatgagtagtccacaacgtccccttggtcatccaccggggtgcctggccggccttcccggccccagagcaccacccttccttgctctatcaattcgctctcagactcgaagctgaagccctctggatctgtgaacccgctctcgctcttgccatcgccgctgcccggcacccccaaatcgaggccgtggctgtgggcccctggggctccggggctggccgtgcgggagccagcctttttgccaccctccaggtcgaaaccggccccacaaacggacaccttgtcgggggagctcatggcgccagtccgggcagcctgggctgcggggagacggtcgtcctggtaacggcgggagcggagagctgagcccagccaagcccagctgagcgggccacgcgacagaaacagtgaggccttcgggacaccaccgccctcgccccaggcggaagtaccagatgtccgggacagcgagtggcttcctcgcgcccttgacgccggcgccgagccttctcattggtccccgtctgccaaccagcacgccctttgtggggcgaggtgcctgagctttaaccaatcgggacacaggctcttggtttgcctccatgcccgtcatttgactgggtggctgcgctctggtcgggtcttggggccagggggcaccgtagctctcgatcacctctttcttcctgtccttctgcctctggccgggcacctactttccaaggagagccacgtctctgagccccagtgtcccatctgtaaggtggggattaaggggagaccttcccccagctcatcagcttgggagagtaaatgtcgtgatgcacgcaaagcacccggtgcacagaggaggtctcattggaaagtaggttcccagccagaggcagcaggagagcaagaaggaggtggatcgagagctccagtgccccctggccgcaagaccagaccagagcacagccacccagtcaaatgacgggtgtcggggcaaaccaagagcctgtgttccgattggttaaagcccagaggcctctgccaacaaagggcgcgctggttggtagagggggaccaatgagaagtcgcggcactggcgtcaagtgcacgcgcagaagccacgcgctgtcggggacatctggtacttccacccggggtgagggcagcggtgtcccgaaggcctcactgttcctgtcgcgtggcccgctccgccgggcttggcaggactcggctctccccttctgccgttaccaggacgaccgtctccccgcagcccaggctgcccagactggcgccatgagctcccccgacaaggtagccgtttgtggggccagtttcggcctggagggtggcaagcaggctggctcccgcatggccagccccggagccccacggggccagggccacggcctcgatttgggggcgccaggcagccgcgagggcgagagcaggttcacagatcccgaggtcttcagcttcgagtctgagagcgaattgatagagcagggaaaggtggtgctctggggccgggaaggccggcctggcaccccagtcgacgaccaaggggacgatgtggactactcgtcctccctggctgacgaaccagccaccatcgtgccaccggcccagcgtccaagggcgcccctccccagaaggtgccgctgccgaagggtcggctgacaactgggcggacctggaggtcggtcccagtgggagaggcgtgctgggccccagccctggagaatggcggcaggcctccgccggcccctgggagcccagggttgccctcgggtaatgctttgtgtggctcctagaaatagaagtccacgttagatggtgggatccgtgtccaggttaaactgatttctgtgtccccccgccccgccccgtcaccaccttctgcatcccacggagagagggtgcctcttttacattgagggtttcatgccaacccacctcaccactgggctgcaggctatgggggctactaagggctgggggagacagggaagacgaggagagaggaggccagaattgactaaccatttatcttcctccggtgtctgctggtctagtgcatccggctgcagagggaaattgaggaccttacacagcagctaggtatgatggagccctggctggggcagggatggacagcggtgtctttctgctggtgcggggggcgggggtgggctgtaggtacaggcggcgtcactggaactgactttcctttggggaagagaaccaaggaaagcctggccctggagccttctgtgcctttccagctaggggtgtgcacagacagcaatgtgtcgtctgaactccgtgtacacttagtccacgagtcccagaactctccttctcttaggagggttagagataccgcatgtgttttccctttaactgctgcctggtatggcttgtacggtgtttgcttgctggctggcttatctgtctttgaaacacgttctgaatgaacggttctggcatggcccagcacctgagaaccactttcccgcttagaaggcatttccacatttaattcaggtgacgggtggatgagtcagtcccagggctggtggggtttctggttgcagggctaggtggttccccacgggggcagggggtgagtttctgtttccctgggtctggagtgcccggttctgcctctctgtttcagcggccatgcagttcttcaacgacaagttccagggcctttgaagtgagtgttgcacacaccgtgccccttcccacaatcccggtagcttaggagggctgtgggctggccctggctgggagccagtccctgagcctgctctgtttcacaggttggagccagcgtccggagctgcagccaagcgagtttcctccttatcctccttagccagggctttttctcttccgctgcatttgcccccttcccaacgcagttcaaagcagtgtgaaataaagtcgttctcatattctgtggtctgtggtctgccctctctgcgattgttgggagtgttggggtgtgccgggtgttgctccgttccctggcgctggaagaacagttcccctggcgctctgtggtgggccatctccctgcggggcgcctgggcgggcctctgagcagcagccctgcactcgggctcaccatagtgccctgggtctaggtgctgtgggaggccctgcccggccacagcagcatttcctgcttttcctgtacacgccctgctcatgctccctcctcttctcctcccactttggggtctcacaggtccccttcttcagtgctattctctctccccttcagcaggaactgatggcctcctttgagcaccctggtcctttgagcaacctttcctcctgcagttcactgtccctgtttgtcctgtcactgtcctttccatcatgagcatccttgctctcccccgtggcttgaccccggtggccgttcctgcatggttatttccgtgctgttgaggaacacgacggagctcagtcctctttctggagccattatttccctccggtgccaccatgcacacggtcaggtcatctgggccagtaacctgcgtgacatcctcagttcgtcttagccctcacctttgaacctcagttatcaaatcccgttaggtctccctctttagtttcagtagccttgtggaggcagaagccacaccccggtggctggctaagtcaaagggaaggtagatggagtgcagaagaaaagggcaagatagtctgttggttggaggtgggggcaccgagtctgttctggcgcctgttggccaacctggtggaaactgttcgcaggcacctacacagaaagtggcttccatatccttggtgttctataggtggccagcagccccttctgcagccagtggactccatacccttgatttgaaaatggccagctgctttccagggcaagtgtggatgctaggcctggctggtcttcgatagtccctgtgaaataccatttcaccacccccaaggccgcaggtttttgtggacataatattttcgcgtccctggtcagtcttccagaccgcctctccaggtcacacgagatttcctcgagctctctcttctgccttcaccatccctgacagttgagatcgcctcgttccttcagccggcatcctgggctgggcaggccccagattcgggcatagattctggttccagtgaggaggtgtgtgtaggttctgccagctcccattgccaagagactgggtgttgcgaacagacaaaaacaatagaaatgcagataccattcaaggttagcgtgtgtgtgtgtgtgtgtgtgtgtgcgcgcgtgagcatgcccctgctagcacctgcttgggaatcaaattaatcgtgggtgctgtcccttgagcgagaatggactgattcatggagtggaagcagtggtgaaggatccatgaaggatcgaattcgctaaagcagggctgggatctaccctttcacaagaggtgttgttcaagtctaacacctagaaggctgtggagtgggacgaaggggacatccccaaacacagggacgggtgtcggggctctcagaatgctggaggtgccacagtaggctcctgatcctccacaggatggatgggatgtctcagcactcccgtgtgtgggtgcagtgataatacctcagagtcgctggttggtgcctcatctaggaaatggggagctcccgtgggagggcaccacgatgcccgctaaccaacacatgggcaagatacgcacagagagggtggaaagtgggaaagagagactgccctgggacagctggttgggctcggtatctgccttcccccatactccctctgtgtctccctgctgggctcatggtgtgagctcagcgagggggaccaccacgcacgtggtgggtcaatcacagacctcagacctggaaaccaacgctggtggggacctaccccatccgaatctaacccctcaccggagaggatgggcttgactccttgggccaaggctttgaccctgacacaggtggttgtttcttggggggataacacagtgggctggtgtctgggggaagacatgtgtcagggactctccagcttgggtttttgccaccggagacatctaggcaggttctggtgggggcagaactccagccccagtcactgccccggggggcatgggccatggtcgacagggtgtggaaggggagaagcccgtggacggagtcttggaaggcgtgaacccatccctcagttgctggcttttgccagccccgcctcccagcacgccacctcggttccatattcagaccaccttctgcacaataatggggccataacatgtacaccctaggcccatggtacaccgcatggtcgggcggagccttctggttctaggggatgtaagtgcagaatccgaggctcctcggattagaggaatccatctgggtcccattggacaggaggaggttgagcccttcccctcattcagtggcccccttttgcttttccctcaagcctcctctcccaccaagaggaatgtggggtctggcctggagagccttagaccccctcctgccttgtcctgccactcagctcagatgagctccagaggtctggtgagctgcgtgcctgccacagtggcggagccctgtgcagaatcccacctacacctggtgccaggactgccacaggtacatttccatatgagacctcttactttgttggcagaaaagagcatctcctcttcagactccagctagggccgaaggtgtgtgagtctcctagcacgcccgccagccagagtccccaagggtggccttccaggctgtggcggaggcccagggcaccgcacacggggatgtgagatggcaatcataggatcatagtggtcatggtgagtaccagccatgaactttagcccgcctggaacacactcctgggtgaactcggacaacctcatgcacatctgtcctcaacctccaccccaagaactcctccttttccccacacattttctcatcatgcgtttcctcgaaggatgaggccaacacttgtgtttgccaggtatggccgcggaggctgtggccgccagggtggccgtgcaaactctatctgtgggattccagggtgctccgttctcgtgatccagtgtgaacggcgcccatgtggttgtgcagttgttgaagtccgggtcactaccatgcagagcgaggaacagaaggttggcagggttttggaaccctcctgtttgccccatcctgatcactacttcccactttgcacaccacagaggaaatgactctactgacttttccaacaatcagtcactttctcttaaaggattaataattgccatttaataaccatcatcaagatataaaagttagaggcggttaaatgtaaaattacatttttgaaacataatacacccccccacgcacgcacacacccatacactctctgtctcacatacacgcacacacacgcacacggagagaactcagaagccggccatttgacaaacagttgtaaggtgatcaagccaggtagctattacccaggtcatgaaactgtacattgcacctttagggaatcgcagtccgagtgtctttctctgaaggaagccaaatgcacatgctacgtaccgtgtgattccatttatgtgacattctggaaaaggcaaaactctaggaacacaaaacagattgatggttgccagggtctga

SEQ ID NO: 2290 - DNA, 1100 bp, artificial
  synthetic oligo
cgcctaggtctcccaaactgttgggattacaggcgtgagccatggttcccggcccatcaagtctcttcagtgtcctttaaagtgtgctttaaagcaatgtttaaagtgtgctttaaatcactgcagctgttgtcgggaagcccttgaacttggctttgtcgagtggcttccttgtgattagattcaggtaggtttaacatttttggcaagactactgcatagcagacgtgccgtccttctcggtgcatgacatcagcagattctccatgtaggcttctctcatgactggcgatgttcatcttgaccgaccatgtggccagggcgttgttccagattactccattgtgaaggtgccatcttctctttgtatttaattagctatgtgctgttactgcatgggcactctgtgtgaatatccagttcccccacaacatcctctttctatcttttggatgtctgcatatgatatggcttggaaccgtgtccccaccaagtctcgtgtccaactgtgacttctaatgttggaggtggggcctggtcggaggtgactggatcatggggctggatttctcaggaatggtttagcagcatccacttggtactgtcctcatggttgcgaatgagttgtcatgagtctggtcgattaaaagtgtgtgacacctctcctttctctttcttgctcctgctcctgctcctatcatgtaacaggtacctgcttctgtttcaccttccgccgtgattgcaagcttcctgagtcctcccagaagcagaagccgctatgcttcccttcccgtacagcctgcagaaccatgagctcttctctttataaatgactcggtcttggatatttctatatagcaacacgagaacggacgtaacatcgtttgtgcttatttctcccttttctttcctgatagcggtgcccttctcccttgttttcttgaccagtctcacaagagttttaccaatttcattcctcttccaaacacccagcttctggttttgtgatccttatgcttgttttcgctttcactgatttctccttttaccttgatgacctccttctactttccttggtcttacgttgggcttcttttttg

SEQ ID NO: 2291 - DNA, 1850 bp, artificial
  synthetic oligo
tgcctgatctcagcctcattcctccttcaagaggaaaccaacacatttacttttgtgatcattctttcctcagttttctctatgatttttggtcccacgtcctatactacattcttttatctttttttttttttcctttttctggagaacggggtctcgctatattgcccaggcaggtctcgaactcctgggctcaagctatcctcccgcctcttgcctccctgagagctgggattacaggcgtgagccaccgcgcccggcctacattcttttaatactacagtatgcctgcagacgacatgttcctaaatctagaaaaccccacagtctcagccccaaagctccttaagctgataaacaacttcagcaaagtctcaggataccaaatcaatgggaacaatcactaacattcctatatgccaacaacagtcaagcagagagccaaatcaggaacacagtcccattcataattgccacacacacacacacacacacacacacacacacacacacacaagatacctgggaatacaccacaccagggaggtgaaagatctctgcaagaagaactacaaaacactgctcaaggaaatcagacatgtcacaagcaaatggaaaaacattcatgctcatggataggaagatcaatataattaaactggccatactgcccaaagcaatttgcagattcaatgtgattcctagtaagttatcattggcattcttcacagaactagaaaaactattttaaaattcatatggaactgaaaaagagcctgagtggccaaggcaatcctaagcgaaaaagaacaaagctggaggcatcacgctacccgacttcaaaatataccacgggcccacaataaccaaaacagcatggtactggtacaaaagcagacacggagtccaatggaacagaatagagagcccagaaataaagccgcacacctacaactctctgatatttgacagacctgacaaaagcaagcaatggggaaggtattctctgttcggcaaagggtgctgagataactggctagccatacatggaagactgcaactggatccctttcttacaccaggtactggtctgttctcttgctgctaataaagacatacccgagactgggtaatttataaagtaaagaagtttaatggactcacagttccacatgccttgggaggcctcacaatcgtggcagaaggcgaaggaagagcagaggtgtgtgttccatggcggcagaaaagacagcatgtgcaggggaactgccctttataaaaccatgagaactcatgagacttattcgctatcacgaggacagcacgggaaaaatccgtccccatgattcaattacctcccaccggatccctcccacaacacgtggggatcatgggagctacagctcaagaggagatttgggtggggacacagccaaagtatatcataccgtatacaacaattaactcaacatggattaaagacttaaattaaaaccccaaaatataaaaaccatggaagacaacttaggcaatcatattctggacacaggaacgagcaacgatttcatgacgaagacaccaagagcaattacaacaaaagcaaaaattgacaaatggggtctaattaagctaaagagcaagcttctacacactaaaggaaactgtcaacagagtgaacagaaaacctacagaatgggagaaaatttttgcaaactgtggatctgacaaagatctaatatccagcatctataaggaacttaaacaagttccacaagaaaaataccaaacaaccccattaaaaagtgggcaaaggacatgaacagacacttttcaaaagaagacatacatgc

SEQ ID NO: 2292 - DNA, 17500 bp, artificial
  synthetic oligo
tatcaataaactgatattagtactcgcaaggagatctgctataaatagagaaaataaaattttggttatccttctggttataaaatacttacctgtttaatgcagtgttacttcccttagcactattgttttgtctgcttatggtggcaggcaacgtacagaaagaaaacatcacagtttatgtgcatagtttaataaatgattgtccagtgcacctgcacaggaacgctcccctaggtcccagagaagaacaccgccagcattccccagagcctcctggggtgtccctgcctgagctcagccccactcctactgcaaggggaaaccaacatcctgacttttctgattgtcctttccttgctcttctctgtggttttatatcctaagtatgcattcttcaacaaggtaggttagtgttgcctgtcatttgaagttataggaatggaatcattaagcatgtccgtgttgtcccttgcttctttccctcgatgttatctttgtaagattcgcgcctattattccatggaggagtactttgtacttcgtacttttccgttgctgaaatagtattccattgtattaacataccacaatgtattcattccgtcccatgaaagttgcgattttcatggtttcccatatttggaactggatgatcacaaaaatactactcataaacccttgtcggcaccagtaaaggagtcctgagagggacgtgtaggctgctaaaagcacatatttaaaagaggatcgcagacaattaacgagaaaacgttcaaaaaagaagcccaacgtaagaccaaggaaagtagaaggaggtcatcaaggtaaaaggagaaatcagtgaaagcgaaaacaagcataaggatcacaaaaccagaagctgggtgtttggaagaggaatgaaattggtaaaactcttgtgagactggtcaagaaaacaagggagaagggcaccgctatcaggaaagaaaagggagaaataagcacaaacgatgttacgtccgttctcgtgttgctatatagaaatatccaagaccgagtcatttataaagagaagagctcatggttctgcaggctgtacgggaagggaagcatagcggcttctgcttctgggaggactcaggaagcttgcaatcacggcggaaggtgaaacagaagcaggtacctgttacatgataggagcaggagcaggagcaagaaagagaaaggagaggtgtcacacacttttaatcgaccagactcatgacaactcattcgcaaccatgaggacagtaccaagtggatgctgctaaaccattcctgagaaatccagccccatgatccagtcacctccgaccaggccccacctccaacattagaagtcacagttggacacgagacttggtggggacacggttccaagccatatcatatgcagacatccaaaagatagaaagaggatgttgtgggggaactggatattcacacagagtgcccatgcagtaacagcacatagctaattaaatacaaagagaagatggcaccttcacaatggagtaatctggaacaacgccctggccacatggtcggtcaagatgaacatcgccagtcatgagagaagcctacatggagaatctgctgatgtcatgcaccgagaaggacggcacgtctgctatgcagtagtcttgccaaaaatgttaaacctacctgaatctaatcacaaggaagccactcgacaaagccaagttcaagggcttcccgacaacagctgcagtgatttaaagcacactttaaacattgctttaaagcacactttaaaggacactgaagagacttgatgggccgggaaccatggctcacgcctgtaatcccaacagtttgggagacctaggcgggcggatggcttgagctcaggagttccagacgagcctgggcaagacggtgaaaccctgtctctacaaaaaatatgttaaaaattagccaggcatggtggcactcgcctgtagtccaagttactcaggaggctgaggcaggaggatggcttgagcctgggaggtcaaggctgcacttagccaggttcacgaccctgcaagccagcctgggcgacagagggagaccctgtctcaaaagagacttgactactaaatgcaaagcatgatgtttggttggaaagaaaattttgttagaaagcagccatgagggatactatgtgaccatggggacaatcggaaaatgtttcatgtgatcatacagtagaaaattgtgtggtctcaatgttacatttcctgagtgtcatggtggcattaaggttttgtgggagcccatgcttccctgtaggcgatacatgctgcagtatttacggatgatggatctaaatgattccaatggatctcaaatgattccacaaaacaataaaaaaaaaaaaatacacgcacacgctcagaaaaagatgggggcgcggcatggagggagggatgaagcaaatgtgagaaaatggtaacaactgcaggatccagtagaagaatatacgtatgggtgctcctttggctttctgtgcaactcttctgtgacttcctaattttaacaaatgcaatctgagatgaagggggatattatggaccactttattacagtcagtttgaaaacaaagaaaaaggtaaccagtcgctaggaaacaaaatccaccaaaactaacacaagaaggaacagccaacctgaaccgttccagaatcattacagaaagatatgagtagtcaaaggctttccactaataaactctaggattccccaccacattctgaaaaacatcctaggaatacctgtcttccgtttgacacaaactcgtgcagaaaattgaaaaggaggaacaatcctccactcactgtatgagcttggcataacctcgataccaaatcctgcagggacacttagagaaatattgcagatcaatcacaggctcatgacatagaagtaaaaactggaaccagaatcttagcacacggaagcctacaggatataaaaaggaaaatacctaatatggcatgactaatattggcttcatcccagaaatacaaacttaatttctcttcagaaaatacaatggtataattctccacattaacagatttggagagagaagcatgctcttcatagtcacaaaaggtattgactaaatgtcaatttccatttgagatgtattgctgacaatttttttttctaaaaagtcaggactattgggctataacttacacagaggtctgtgagatctcgtaaatgcgtatggctgtaaaaacaccagcacaatatatatagatatagagcatcgccatcccccgcccccctcccccgccaggttcccttacgtcctcttgtactgaactcctcgtcttaaccctcagaccctggcaaccatcaatctgttttgtgttcctagagttttgccttttccagaatgtcacataaatggaatcacacggtacgtagcatgtgcatttggcttccttcagagaaagacactcggactgcgattccctaaaggtgcaatgtacagtttcatgacctgggtaatagctacctggcttgatcaccttacaactgtttgtcaaatggccggcttctgagttctctccgtgtgcgtgtgtgtgcgtgtatgtgagacagagagtgtatgggtgtgtgcgtgcgtgggggggtgtattatgtttcaaaaatgtaattttacatttaaccgcctctaacttttatatcttgatgatggttattaaatggcaattattaatcctttaagagaaagtgactgattgttggaaaagtcagtagagtcatttcctctgtggtgtgcaaagtgggaagtagtgatcaggatggggcaaacaggagggttccaaaaccctgccaaccttctgttcctcgctctgcatggtagtgacccggacttcaacaactgcacaaccacatgggcgccgttcacactggatcacgagaacggagcaccctggaatcccacagatagagtttgcacggccaccctggcggccacagcctccgcggccatacctggcaaacacaagtgttggcctcatccttcgaggaaacgcatgatgagaaaatgtgtggggaaaaggaggagttcttggggtggaggttgaggacagatgtgcatgaggttgtccgagttcacccaggagtgtgttccaggcgggctaaagttcatggctggtactcaccatgaccactatgatcctatgattgccatctcacatccccgtgtgcggtgccctgggcctccgccacagcctggaaggccacccttggggactctggctggcgggcgtgctaggagactcacacaccttcggccctagctggagtctgaagaggagatgctcttttctgccaacaaagtaagaggtctcatatggaaatgtacctgtggcagtcctggcaccaggtgtaggtgggattctgcacagggctccgccactgtggcaggcacgcagctcaccagacctctggagctcatctgagctgagtggcaggacaaggcaggagggggtctaaggctctccaggccagaccccacattcctcttggtgggagaggaggcttgagggaaaagcaaaagggggccactgaatgaggggaagggctcaacctcctcctgtccaatgggacccagatggattcctctaatccgaggagcctcggattctgcacttacatcccctagaaccagaaggctccgcccgaccatgcggtgtaccatgggcctagggtgtacatgttatggccccattattgtgcagaaggtggtctgaatatggaaccgaggtggcgtgctgggaggcggggctggcaaaagccagcaactgagggatgggttcacgccttccaagactccgtccacgggcttctccccttccacaccctgtcgaccatggcccatgccccccggggcagtgactggggctggagttctgcccccaccagaacctgcctagatgtctccggtggcaaaaacccaagctggagagtccctgacacatgtcttcccccagacaccagcccactgtgttatccccccaagaaacaaccacctgtgtcagggtcaaagccttggcccaaggagtcaagcccatcctctccggtgaggggttagattcggatggggtaggtccccaccagcgttggtttccaggtctgaggtctgtgattgacccaccacgtgcgtggtggtccccctcgctgagctcacaccatgagcccagcagggagacacagagggagtatgggggaaggcagataccgagcccaaccagctgtcccagggcagtctctctttcccactttccaccctctctgtgcgtatcttgcccatgtgttggttagcgggcatcgtggtgccctcccacgggagctccccatttcctagatgaggcaccaaccagcgactctgaggtattatcactgcacccacacacgggagtgctgagacatcccatccatcctgtggaggatcaggagcctactgtggcacctccagcattctgagagccccgacacccgtccctgtgtttggggatgtccccttcgtcccactccacagccttctaggtgttagacttgaacaacacctcttgtgaaagggtagatcccagccctgctttagcgaattcgatccttcatggatccttcaccactgcttccactccatgaatcagtccattctcgctcaagggacagcacccacgattaatttgattcccaagcaggtgctagcaggggcatgctcacgcgtgcacatgtgcgcgcgcgcgcgtgcacatgtgcgcgcgcgcgcgcgcacacacacacacacacacacacacacacgctaaccttgaatggtatctgcatttctattgtttttgtctgttcgcaacacccagtctcttggcaatgggagctggcagaacctacacacacctcctcactggaaccagaatctatgcccgaatctggggcctgcccagcccaggatgccggctgaaggaacgaggcgatctcaactgtcagggatggtgaaggcagaagagagagctcgaggaaatctcgtgtgacctggagaggcggtctggaagactgaccagggacgcgaaaatattatgtccacaaaaacctgcggccttgggggtggtgaaatggtatttcacagggactatcgaagaccagccaggcctagcatccacacttgccctggaaagcagctggccattttcaaatcaagggtatggagtccactggctgcagaaggggctgctggccacctatagaacaccaaggatatggaagccactttctgtgtaggtgcctgcgaacagtttccaccaggttggccaacaggcgccagaacagactcggtgcccccacctccaaccaacagactatcttgcccttttcttctgcactccatctaccttccctttgacttagccagccaccggggtgtggcttctgcctccacaaggctactgaaactaaagagggagacctaacgggatttgataactgaggttcaaaggtgagggctaagacgaactgaggatgtcacgcaggttactggcccagatgacctgaccgtgtgcatggtggcaccggagggaaataatggctccagaaagaggactgagctccgtcgtgttcctcaacagcacggaaataaccatgcaggaacggccaccggggtcaagccacgggggagagcaaggatgctcatgatggaaaggacagtgacaggacaaacagggacagtgaactgcaggaggaaaggttgctcaaaggaccagggtgctcaaaggaggccatcagttcctgctgaaggggagagagaatagcactgaagaaggggacctgtgagaccccaaagtgggaggagaagaggagggagcatgagcagggcgtgtacaggaaaagcaggaaatgctgctgtggccgggcagggcctcccacagcacctagacccagggcactatggtgagcccgagtgcagggctgctgctcagaggcccgcccaggcgccccgcagggagatggcccaccacagagcgccaggggaactgttcttccagcgccagggaacggagcaacacccggcacaccccaacactcccaacaatcgcagagagggcagaccacagaccacagaatatgagaacgactttatttcacactgctttgaactgcgttgggaagggggcaaatgcagcggaagagaaaaagccctggctaaggaggataaggaggaaactcgcttggctgcagctccggacgctggctccaacctgtgaaacagagcaggctcagggactggctcccagccagggccagcccacagccctcctaagctaccgggattgtgggaaggggcacggtgtgtgcaacactcacttcaaaggccctggaacttgtcgttgaagaactgcatggccgctgaaacagagaggcagaaccgggcactccagacccagggaaacagaaactcaccccctgcccccgtggggaaccacctagccctgcaaccagaaaccccaccagccctgggactgactcatccacccgtcacctgaattaaatgtggaaatgccttctaagcgggaaagtggttctcaggtgctgggccatgccagaaccgttcattcagaacgtgtttcaaagacagataagccagccagcaagcaaacaccgtacaagccataccaggcagcagttaaagggaaaacacatgcggtatctctaaccctcctaagagaaggagagttctgggactcgtggactaagtgtacacggagttcagacgacacattgctgtctgtgcacacccctagctggaaaggcacagaaggctccagggccaggctttccttggttctcttccccaaaggaaagtcagttccagtgacgccgcctgtacctacagcccacccccgccccccgcaccagcagaaagacaccgctgtccatccctgccccagccagggctccatcatacctagctgctgtgtaaggtcctcaatttccctctgcagccggatgcactagaccagcagacaccggaggaagataaatggttagtcaattctggcctcctctctcctcgtcttccctgtctcccccagcccttagtagcccccatagcctgcagcccagtggtgaggtgggttggcatgaaaccctcaatgtaaaagaggcaccctctctccgtgggatgcagaaggtggtgacggggcggggcggggggacacagaaatcagtttaacctggacacggatcccaccatctaacgtggacttctatttctaggagccacacaaagcattacccgagggcaaccctgggctcccaggggccggcggaggcctgccgccattctccagggctggggcccagcacgcctctcccactgggaccgacctccaggtccgcccagttgtcagccgacccttcggcagcggcaccttctggggaggggcgcccttggacgctgggccggtggcacgatggtggctggttcgtcagccagggaggacgagtagtccacatcgtccccttggtcgtcaactggggtgccaggccggccttcccggccccagagcaccacctttccctgctctatcaattcgctctcagactcgaagctgaagacctcgggatctgtgaacctgctctcgccctcgcggctgcctggcgcccccaaatcgaggccgtggccctggccccgtggggctccggggctggccatgcgggagccagcctgcttgccaccctccaggccgaaactggccccacaaacggctaccttgtcgggggagctcatggcgccagtctgggcagcctgggctgcggggagacggtcgtcctggtaacggcagaaggggagagccgagtcctgccaagcccggcggagcgggccacgcgacaggaacagtgaggccttcgggacaccgctgccctcaccccgggtggaagtaccagatgtccccgacagcgcgtggcttctgcgcgtgcacttgacgccagtgccgcgacttctcattggtccccctctaccaaccagcgcgccctttgttggcagaggcctctgggctttaaccaatcggaacacaggctcttggtttgccccgacacccgtcatttgactgggtggctgtgctctggtctggtcttgcggccagggggcactggagctctcgatccacctccttcttgctctcctgctgcctctggctgggaacctactttccaatgagacctcctctgtgcaccgggtgctttgcgtgcatcacgacatttactctcccaagctgatgagctgggggaaggtctccccttaatccccaccttacagatgggacactggggctcagagacgtggctctccttggaaagtaggtgcccggccagaggcagaaggacaggaagaaagaggtgatcgagagctacggtgccccctggccccaagacccgaccagagcgcagccacccagtcaaatgacgggcatggaggcaaaccaagagcctgtgtcccgattggttaaagctcaggcacctcgccccacaaagggcgtgctggttggcagacggggaccaatgagaaggctcggcgccggcgtcaagggcgcgaggaagccactcgctgtcccggacatctggtacttccgcctggggcgagggcggtggtgtcccgaaggcctcactgtttctgtcgcgtggcccgctcagctgggcttggctgggctcagctctccgctcccgccgttaccaggacgaccgtctccccgcagcccaggctgcccggactggcgccatgagctcccccgacaaggtgtccgtttgtggggccggtttcgacctggagggtggcaaaaaggctggctcccgcacggccagccccggagccccaggggcccacagccacggcctcgatttgggggtgccgggcagcggcgatggcaagagcgagagcgggttcacagatccagagggcttcagcttcgagtctgagagcgaattgatagagcaaggaagggtggtgctctggggccgggaaggccggccaggcaccccggtggatgaccaaggggacgttgtggactactcattctacctggctgacgaaccagccgccatcgtgccgccgcccagcgtccagggacacccgttcccagaaggtgccgctgccgaagggtcggctgagaattgggcagatgcggaggtcggtcccagtgggagagacgtgctgggccacagccctggaaaatggcagcaggcctctgccggccgtctccacctctgcggtcctgggccagtgcgggcctggaagaacccggaaaggggctcgaagagcagatggagcctccgcgtggatccccagcagccctctgcgaaaggccccaccaggctgcctacccacgactctgattccgcagatgagagcagcgacttaccactgatgaaggtaggcatttgccgcaacgaaggaagccaggccaagcccggcagccccaagaagcgagcagacacatccagacaggcaagcttccactgcaaggagagttacctgcctgtgccgggccgtttcctgacctctgctccccgcggactcactccagtcgcagagaggccggctgtgggagagctggaggactctccccagaagaaaatgcagagcagggcctggggaaaggtggaggtcaggcccagctgctcaggagctgctgctgcaggggccctgccccagggcctttcgaggaggaagatggccggggggaagaagtccctagggggtgcctctcaactggccctggggagaggctttcctgcctgcggagagagactctcagccgctcccccggagccggccaccttcccgccattctctggtgtgcggccacaggggatgtccaagaaaccccaaaagcctaagcacagcagccctgggaagaaaccagcagggaggaagaccagggagtcccaggctgcggccagagaagataatgacccaaatagagatgaggtcccaagagcccaagtgagtaggcccttctcgccctcctctccctctttaccctcctccccccacacctcctctcttccagcacacacctgtttacccatgcctcctctgtcccttgctcgagggttgtcatcgggagcccagggacactagaatgcccgatgggtgtcttcctcataagggcacacgttaaagggagcacttcttgtgtgatggccatgcctctggacgctctgcaggggtcctgcctccgcccgcagagaggagctggggtggaaggcagggctggcagctggtttggatcgggtgatgccttaaagtgtgggctgcaaagctggggcatctaggctcatcaacttcctgattcctccttccctagctgttgcccaacccacctggcaggcggccccgggctatctcagtatccccagtgttttccctggctggcctctgcctcctggcctgaggctgactgagggagaaagtgctaatgagattaggctcaggagtctccaccttaccacaacccctccccacgtgtactcaccgccggcccccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtgagtcttgtgggtttgataggggtggaggggagaggggtcgggagggaaacctctggccctgtcgcttctgggggctcagccttattcccagacttccctgcccacccaggcagctgtcccacggggaaacggggtgttgactgggctggctttaagccacatcgtcctctctgagtggggtttgtgtggtggggggcgatttggagcagcgccccaaactcccaactctggaaggagactttcggcagtactgagcccttttctgttaagtcctgctcagccacatgggccctcccagggcctggctgtggctgccgcactgctggagtccaacctggagtcacaatgctagggggccacaggtgcacatgagcttacactggggaacagtgaaggcagtcccagagcggggttggagttgctgggcagagcaggggcaacgtgtaccagcagagggtgatgctgcctcacattagacaccactaggccctttccacctcactgggaggcttggaagctggattttgtgttctctttcaggtaaccagcagccgcctgtccatcccccaagaccggaaaggcagcagcagcccccgggagcccagggctgtcctcgggtaatgctttgtgtggctcctagaaatagaggtccacagtagatggtgggatccgtgtccaggttaaactgatttctgcgtccgccccctccctccccaccgcactccgcacatctccaccttctgcaccccacggagagagggtgcctcgtttccattgagggttccctgccaacccacctcgccactgggctgcaggctatgggggctgcagggaggctggggagagaggagcacagaattgaccaaccatttatcttcctccggtgtccgctggtctagtgcatctggctgcagagggaaattgaggaccttacacagcagctaggtatgagggagccctggctggggcagggatggacagcggtgtctttctgctggtgttgggggcggtggtgggctgcaggtatgggcagcatcactgggactgactttcctctggggaggagaatcaagcagacctggccctggagccttctgtgcctttccagctaggggtgtgcacagacagcaatgtgtcgtctgaactccgtgtacacttagtccacgagtcccagaactctccttctcttagggcggttagagataccacctgtgtttcccctttaactactgcctggtatgacttgtatggtgtttgcttgctggctggcttatctgtctttgaaatacgttctgtacggtactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatattctgtggtctgtggtctgccctctctgcgattgttgggagtgttgggggttgcagcgtgttgcccggttcactggcggttgaagaacagttcccctggtgctctgtggtgggccctctccctgcggggcacctgggccggcctctgagcagcagccctgcactcgggctcaccacagtgctctgggtctaggtgtgtgggggccctgcccggccacagcagcatttcctgcctttctcctacacgccttgctcacggtccctcctcttctcttcccactttggggtctcacagttccccttcttcagcgctattctccctccccttcagcaggaactgatggcctccttccagaacccgtctctctcacctttcctcctgcggttcactgtttctgttctgccctctcaccatcctttccatcgtgagcatccttgctctccccagtggcttgatgccagtggcctttcctgcatggttatttccatgctgttgaggaacaagacggagctcatcctccccgcccctcaggggcccagtcctcttccttgagccgttatgtccctccggtgccaccatgcacagggtcaggtcatctggggcaaaaacccgcttggcatcctcagttcctcttagccctcacctttgaaccttagttaccaaattctgtcagatctcctccttagcttcagtagccaggtggagacagaaaccacatcctggtgggaagctgagccaaagggaagatacctggagtgcggaagaaaagggcaagacagtctctcggttggaggtgggggcactgagtctgttctggtgcctgcgggccaacctggtggaaaccgcccgccggtagctacgcggaaggcggcttccacatccttggtgtcctatacgcagccaacagccccttctgcagccggtgggctccataccattgatttgaaaatggccagctggtttccagggcaagtgtggatgctaggcctggctgttcttggatggttcccgtgaaataccgtttcaccacccccaaggccaacaggtttttgtggacgtgattatttctgtgtccctggtcagtcttcccgaccgcctctcgaggtcacacgagatttcctagagctccctgttctgccttcaccctccctgacagttgggatcgcccgcttccttcagccagaatcctgggctgggcaggtcccagatttgggcacagattccgattccagtgaggaggtgtgtgtaggttctgccagctcccatcgccgagagacagggtgtcgaacaaggacaggagaaatacagataccattcaaggttagcgtgtgtatgtgtgtgtgcacgcccctgcaagcacccgcttgggaatcaaattaatcgggggtgctctccgttgagggagaatgggctgattcacggagtggaagcagtggtgaaggatccatgaaggatcgaattcgctaaagcggggctgggatctaccctttcacaggaggtgttgttcaattctaacacctagaaggctgtggagtgggacgaaggggacatccccaaacacagggacaggtgtcggggctctcagaatgctggaggtgccacagtaggctcccgatcctccgcgggatggatgggatgtctcagcactcccatgtgtgggtgcagtggtaatacctcagagtcgctggttggtgcctcatctagaagtggggagctcccgtgggagggtgccacgacacccgctaaccaagacatggacgggcaggatgcccacagagagggtggaaagtgggaaagagggactgccctgggacagctggtcgggcccggtgtctgccttcccccatactccctgtgcgtctccctgtgggcccatggtgtgagctcagtgagggggaccatcacgcacgtggtgggccaatcacaggcctcagacctggaaacgaacgctggtggggacctaccccatcggaatccaacaccttccctgagagggttggcttgattcctcgggccaaggctttgaccctgacacaggtggttgtttcttggggggataacacagtgggctggtgtctgggggaagacgtgcgtcagggactctccagcttgggtttttgccaccggagacatctaggcaggttctggtggcgtgagaactctagccccaggcactgccccggggggcatgggccatggtcaacagggtgtggaaggggagaagcccgtggacggagtcgtggaaggcgtgaacccatctcccggtggctgcatttgccagccccgcctctcagcacaccacctcggttccatattcagaccacctcccgcacaataatgaggctgtaacatgtacaccccaggccatgggcgggtggagccttccagttctaggggaaataggtgcagaatccgagactcctcggattagaggaatccacctgggccccagtggagaggaggaggtcgagcccttcccctcattcagtgtcccgctttgtcttttccttcaatcctgctctcccaccaagaggaatgtggggtcccgcctggagagccttagaccccctcctgccttgtcctgccactcagctcagacaggctccggaggtctggcgagctgagtgcctgcccttgatgcagccacagtggcagagccctgagcagaatcccacctacacccggcgccagggctgccacaggtacatttccagatgagacctcttactctgtgggcagaaaagagcatctcctcttcagactccagctagagccgaaggtgtgtgagtctctgcacacgcccaccagccagagtcccctagggtggccttccaggctgtggcggaggcccagggcatcgcacacggggatgtgagatggcagtcataggatcatagtggtcatggtgagtaccagccatgaactttagcccgcctggaacacactcctgggtgaactcggacaacctcacgcacatctgtcctcaacctccaccccaagaactcctccttttccccacacattttctcatcatgcgtttcctcgaaggatgaggccaacaccagtgtttgccaggtacggccgcgtaggctgtggccgccagggtggccacatctatctgtgggattccagggtgctctgttctcgtgatccagcgtgaacggcgcccatgtggttgtgcaatgttgaagtccaggtcactaccatgcagagcgaggaacagaaggttggcagggttttggaaccctcctgtttgccccatcctgatcactacctcccgctttgcacaccccagaggaaatgactctgctggcttttacaataatcactcacttccctttaagtattaataattgtcatttaataaccctcaccaacatataaaagttagaggcagttaaatgtaaaattatatgtttgaaacatgatacacacacacacacacgcacacacacacacacggagagaactcagaagcccgccatctgacaaacagttgtaaggtgatcaagccaggtaactactacccaggtcatgaaactgtacattgcacctttagagaatcgcagtccgagtgtctttctctgaaggaagccaaatgcacatgctacgtaccgtgtgattccatttatatgacattctggaaaaggcaaaactctaggaacacaaaacagattgatggttgccagggtctgagggttaagacgaggagttcagtacaagaggacgtaagggaacctggcgggggaggggggcgggggatggcgatgctctatatctatatatattgtgctggtgtttttacagccatacgcatttacgagatctcacagacctctgtgtaagttatagcccaatagtcctgactttttagaaaaaaaaaattgtcagcaatacat

SEQ ID NO: 2293 - DNA, 1350 bp, artificial
  synthetic oligo
cagccctttctccctcaagggagagcatctccgattaatttgattcccaagtgggggcatacatgggcaccagcccatatgcgtgcgtgcatgcgtgcacgcacacgcacgcgcacacatgcacacacacgggacacacaaccacgtgtcgatttggtcatgtgttgtaagaaaaagaaataaaaggcgccaaactagacagtaagaagctcaattatctctgcttgctgatggcatgaagtcacatagagaaaaccctgatgtgcactgcaccaaaaaacgatcaaaaccaatagacaaagtcagcaaagttgcggaatggaaaagcaacatgcgaaaatctctcgcttttctatgcctgaacaacaaactatcccaaaaagacacccgggaaaccaacatatttagaatatcaggccaagaataaaacccttggaatacgtttattcagggaggtgaaaggtgtgcacactgaaaccgatcaaacactgatgaaacaggcagaagaccaaaaaatagagacacatcctgtgttcacggacgggaagacggttaacacataggtgctacccaaagctgttacacattcaatgcagtgagtccctaggaaatcgacaatggtgtttttcacagcactagcagaaacaaacctaaaacccctgcttcttgactgtgagcctccctgtgagccttgactgtgagctacccaaagctgttacaggtaaaacgcagtgagtcatgccaccgcccagcatccagggacaactgtccctagaaggcatcactgccaaagggtccgctgacattggggcagacctggaggtcggtcccagtgggagaggtgtgctgggccccagcccggggaaatggcagcggaggaacttcgtcggccctctccacctcactggtcctgggacaggcccagcctgagagaacccggaaaggggcttgaagaggagacgcagcatctgcgtggatccccagcagccctccgaggaagggcccgcagggctgtctacccaagactctgattccggagatgagtgcagcgacttaccgttgatcagggtgatcattttcaccaaagaaggaatccaggccaagcccggaagccccaagaagccagcagacacttgcagacgccccagtttccaccgcagggagagttaccttcaggttcagggacctctcctgacctctcctccccgcagactcaccccagccatggagaggccggccgtgggagagctggacacgtcttccttgaagaaaatgcagagcatggtgtggggaaagaggggggtcaggcccagttgctcaggagttgccattagagggcccctaccccgg

SEQ ID NO: 2294 - DNA, 1800 bp, artificial
  synthetic oligo
cattatcttctctggccgcagcctgggactccctggtcttccttcctgctgatttcttcccagggctgctgtgcttaggcttttagggtttcttggacatcccctgcggccgcacaccagacaatagcgggaaggtggccgtttctgggggagtggctgagagtttctctccgcaggcaggaaaggctcttcccggggccagttgagaggcaccccctagggacttcttctcctgggctatcttccttcttgaagggccccggggcagggcccctccagcggcagctcctgagcagctgggcctgacctccacctttccccaggccctgctctgcattttcttctggcaagagtcctccagctctcccatagccggcctctctactactggagcgagtccggggggagcagaggtcaggaaaaggcccagcacgggcaggtaactctccttgcagtggaagcttgcgtgtctggatgtgtctgctggcttcttggggctgcagggcttggcctggcttccttcgttgcggcgaatgcccaccctcatcagcggtaagtcgctgctctcatctggggaatcagagtcgtgccccgcggggcctttcacggagggctgctggggatccacgtggccgctcaacctgctcttcgagccgcttttccgggttctcccaggcccggcctggcccaggaccactaaggtggagagggcctgcagaggcctgctcccattctccagggctggggcccagggcgcctctcccactgggatcgacctccaggtccgcccagatgtcagcggaccctttggcagcggcgctttctgaggacttgtgtccctggacgctgggcggcggcacgatgacagctggcttgtcagccaggtaggacgagtagtccacacggtccccttggttgtcgactgcggtgtcagaccggccttcccagccccagagcaccacccttccctgctctgtcaattcgctctcagaatcgaagctgaagccctcgggatctgttgcccgctgttgccctcgccctcgcccttgctgctgtgcagcacccccaaatcgagatcgtggttattcccgtggccccaaggggctcctgaagtggccatgccagcgccagcctgctcgccaccctccggcccaaaaccggccccccaaagggacacctcgtctggggagctcctggcgccagtccaggcagcctgggctgtggcgagacggtcgtcctggtagcggtgggagggaagagccaagcccagccaagcccagccaagcccagccaagggggccacgcgacaggagcagcaaggcctgcaggtcactgccatcctctccctaggcggcagtaggagatgtcctcgacatcggtggcttctgtgcaccctggaagcctgcaccgtgccttctcattggtccaccctctgccaaccagtgctccctttgtttggcggggcctctgggctttaaccagtcgggacacaggctcttggtttgccccgacgcctgtcattcgactgggtggctgtgctcaggtcgggtcttggggccagggtgcattggagctctccatccatctctttcttcctgtcctgtcgcctctggccaggcacctactttccaatgagagccgcatctctgagccccagtgtcccatctgtaaggcaggagtcaatgggagtgccacccccagctcatcagcttgggagagtaaatgtcgtgatgcacgccaatcacccggcgcacaggagcttcaagcctgcgttccacactaagaggtagcacctgatag

SEQ ID NO: 2295 - DNA, 1850 bp, artificial
  synthetic oligo
cacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggcta

SEQ ID NO: 2296 - DNA, 1400 bp, artificial
  synthetic oligo
acagaatcaagcccaatgcttacctgactttcttcttaaatgccatttatagcttttcttttctttctaaaatggtaaatgtttattatggtgcttgactttcaaggacctctatgaggtggtccaacctacccttcctttgcttgtgtgggggtgaggacctgggaggttagggggaccatgcagcttgatgctatggaaagcacacctcgagctctggaatcagaggttactggttaatctaggccctcccctgcttcttatctgcttgaccccggccctcgcctcaccgttcccccgcccagtttccctcttgttaaggtggtgtgataaaaacgacccctatcccgggttagaggtgaaaactcaacgcgacaagtggaggagagcgggcttttagcgccagaagcttccatgatgcccaggtccgcgggcagggcgagggcacgggccggggaagcaagcgttgccgcgccgctaccgtcgggggccggcccccgggctgcttttcgtgcgcggagcagctcggccagtcaccaggcgcgtgcggaggcggcgagcctgcgagggcggccggtgcgggcgcagccggcgcgatgagtcaccatccctcagcacctccggaacacgaggctgcttggaagcagccgggcccccgcccgccctcctcccccgccccgcggagtggcggcgccagcccgatgcccggcagagggcgctgcagtgcggctgcggggccaccggcccgcgctgctctggctgccaaaggccggcgctgcctttggctcagagggaaagatcggggcccagggatggggtgcgtgaggaatgaatgtttctgcagtgccagaggtggctctgtttttgatccagaaacgaaatggacttcaagattcagacactgggcagagtgatggggccgacacggcccctactggagagtgtccagtcttgatcgccccaagcttttgagcagggatgtcctgtccgaggctggtgtcgtccccactctcgccagagaggatctgtgataggatgagtctcgcctttccaaaatgaatctgcctaaggacccagtccttgatctcctctgtgacctctttcacctgaggtgatggaggttacgaagattggagctgtctgcagtggagcgcaggagaaagtgcacaagctttcgggtgaccagggtttcagtgccagctccatcatgagattgctgtgtgaccttggtcatttcattattcattcattcattcagaaaacactcactgtgtcacaaggcactcacggtgaagggaagagaaggaggccaagcctgtggagacaattgccctgaccataaaatagcttaggccaggtacagaaacccgacacgtaggtaaacactggctgaatgaaca

SEQ ID NO: 2297 - DNA, 1100 bp, artificial
  synthetic oligo
ttgagtaacttgtccaaggtcacacagtgaggaagtcagaattgagatacgaatccacatctctttagttttaaagcctgggctctccacgatatcatcccttcatcttactcagggggaagatgaagattgggtgacttaaggtcattcagggagtcagggatgggactgaggctggaaactcccttcttctgacactgtaagtaaattttcattcggtagctcctctgctcagaagccttcagagaaaccctcttgcctatagaattgaaacttctgagcctgacagccaaggctgtcatggtgcccctgcctcagctcggcttctccttcttccccagcactttacttggcatgtggaggtgctagaccatctctcttttcctcacctaccagtggggttcttccctgaatcctgttcctccctagcctcagtcatgccttagaattcctctaccatggtgcctctgctctctgggatattttctcgacctcaaacacccaggcactctacctgcttctcagaatctttcccatgcttcaagagcataggttctcacccctctgggaagccccccacccaccaaagctgccctgagcccttagagccttgagctaggagcctgtcactttagcagtgctgccgcctgttggtggtttgaagagctccaccccaactcacagatgaggccaataaatattattatactataataagcctctgcagctataccccatggcttgaagaactatttccagaatctttcttctccattctgaacttgctttcattactttaatgtctcaacccatttgggctgctgtaacaagataccatggacatgtggcttaaacaacaattttttttttcttacagttctggaagctgggagttttaagatcactgcacccatagatccggtgtctggtgagggtcctcttccaggtttgcagatggcccccttctccttgtgtcctcacttggcagagaacagagagaggaagcaagctctctgatgtttctttttgtaagggcactaatcccatcatgagggatccaccctcaagaactaatcacctcccaaaggccccatctcccc

SEQ ID NO: 2298 - DNA, 1200 bp, artificial
  synthetic oligo
tcatcatgtctcatctgggccccttccagagcctcctaactggtgtcccggcccctctccaatcagccttccacattgcagccaccctactgatcttcaggtcactcccttgcccaaagcttctgtggctcactatcaccttcaagataaaatccacacccattctcatgacatttaaggcctccctggtctagttccaactacctcatcttctacctggctataccagatcacttatttttcttcccaaatacgagaaaccctcatacctttatgctgttgctcaaaacgtcctctttgcctagaatgtcctctctccaaacctcattttactggcaaatgttgcttcattcttttcgagttcgacatcaccttttcttgatgcccttcccttcctctgagggaaggaattcagttctgggtgctgacaactggcaatgaatggatggctggggagtgaaaggggattgcatcaaatgatggctggggtggttgaggttgcagaatttgagctgatccctaaaaggaataatcttaatgataactaacatttactgagcacttgctatgcaccagaccttgctctatgcactttctatgcattctctttcagtctcattctctagcaaccccaaactcactgtatcctcactttagagatgaaaaaactgagggccagggttctatcagcggttatgaagctttactgaggggcggcttggtgatctgcagcagaacactttcttaccataaatagcagagtagggatagcatctagaatcacttgcaattatgtctgtctttcacacaaaggggaaaaaagtgcatttgacctcagaagcatgaggccatgtggtgaagcacaaagactagtctttgaagtccatctagctgtgtgaccttgagccaatttcctgatctctctgagcttcagtttcctaaagtgcgaattgaggatagtaatagctccattgcaggtttgtggtgcagatgagctatgaggaatgccaaagaatccagcatggtgttaggtacatagaggggctctgtcaacatcaattcatttttctccctccccagtgtctaaggaaagaagtgtagtatggtgaaactcacactacctcagaagtcaaaggagttgtggtttgactctggcactagtaaggctgtgcaaccctcagcaagttacttgccctctct

SEQ ID NO: 2299 - DNA, 2500 bp, artificial
  synthetic oligo
tcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagag

SEQ ID NO: 2300 - DNA, 1700 bp, artificial
  synthetic oligo
tttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaag

SEQ ID NO: 2301 - DNA, 3650 bp, artificial
  synthetic oligo
cgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtcagccccggcttggctcgggagcaggtctggcaacagcggcagcttctccgctgcaggctccggatccgggaggtgtggatccgccctccatctattggatggctcccaggccaattgttagaaagaggcatatgttcatctcggcttctggagtgtctccggagcagttgctcaacagccagccccctcccccatccggaccattgaagggcagaaaaaggagcgccctccaccacatttctctgtgcccacatgccagaaagggtctcccccctggtgacttcctgtcatctccactgcttacctcctggggagcaggaacgagaggggcttcaagcactcagctttgaagcacaaaagccacccctttcctttttggggagatgggagaggaggttagttgcagaggctgagagggagcaaaggagacatttgcatttctcggcaaaaatgctctgatcactgacttccccgttggctccagcagagctcagagctctccgctgaactcttatctccaacttggcaactagaccgcgagcttgcgaagcaaggagaggacagggatggtcacctaccgagaacctctgtgctccagcg

SEQ ID NO: 2302 - DNA, 1000 bp, artificial
  synthetic oligo
gaataaaaacacatgcaaacttttatgaatgatgaaagaaataaagccaatcatgacaggcctggctgagtgttcattatactcataagattgtcactggttctgcaaggtgagcctccaggtaagtgttcacttcttctacagtagttagtttatcgaaaaagttctctcttcttgggaaggatgggacagaaaggggcagggttggagtgattaggcaataacattttagttccatgcacaatcaaccgaggcagggaccagctgtcaaaaggctcccagaagccaggaaccaaagccctcattgcatggcacagatgctgtggggcaggaactcctgcacgtaggtggcggctgccttggagaggtaggtcatggtgccaaacctgccactgggtgcactgtcatacagaagagtacagatgccagatgcgggatcctttgccaacatggtatcatctgcgccaagggttttctgtttggtttttaagggtagaagaacataggggaaaggaaaaattaccaatcttactaagtaaagtcctgattagcataattcagaacctcctccccaacaccaattagttgggccctagactgtttatccaggaagaaataggtttatggacaaaagggtgaatatgagtttgtatgcaggcatttttcactaggtccccaaatcatgtaaattatttaaaaattattaattgtttagaattttccccattatgatcaatttctaaaagttaaatataatcattcatctattgagtcatacctattaatagacaaatgttaacacaaatcaccgtagtagagctttggtctgactccttctagtactactaatttcagcttgtattcttttatcctgcatttgatcatgatttctttctaaggcgacttaattcaaatagactaagttttctgaggctagaggtctatgcctaaaagggaacacatttttagatacatggactgacagcaatccataattttt

SEQ ID NO: 2303 - DNA, 1150 bp, artificial
  synthetic oligo
aagacaagccaacaagacattgagaggttctgaaaaagcaccaccttggtgtcttccctactttacattacaaaccattcaatttaataaaaccaaatgtgttgctagtaaacatttgtattttctgtatcttccatccaggcagattcagagaaaaaaatatatttaggaaacctgccctaaaaagccgacaaccacctcttttctccacctgttggccttctctattcatttaaaaaaatactctttctccttgtcccaaagtttttctcacagcagttttggagaagtggaatgaacagtaggcttggagttgggaactgggttctcatctggactctcactttctggctgtgtaaccttgggtaagttacctaatctctctaagcctgtttttccaccttcctaacaggactaaatgagaatgcactaagtctaagatactaggctgctttctgcgctttgtgagtgtgtgattttttttttttctggcaatcttgctctttctcaagggttcctgggtgaatggcaccgctccctacccacttacccaaaccagaacctgagtcatttgtgacaccttcgtctctttaacactgccttcctacatgtcaaaattgtcattaagtcctatagattctatttcctaaatatttatctgagtcaccttcccatcttgatccccatggtcactggctgagtttctccacagacaattgttaacagcctctaaactagtctctttgccttcagatttgttccttatttttcataccactgcctaattgatcttttaaatccaaatctggctcggttactccctaacataaaattttcctgtggattctcatagcctttagggtaaatccaaaatgtctagtgtgacattgtgatccaggctgcgagtatccatctgttgctttcctttccagtccctgctatattcttatgctttagctgttttcaattatttgcagttgccggaaatcactgtgcattctctcacaattatgctaccccttctgtctgaaagatctcccttcacccattttttacaatttgctaagctagtggtcagttcccgtttctcattttatttgacctattggcagcgtttgactcacttaattgctccctctttgatttttct

SEQ ID NO: 2304 - DNA, 1950 bp, artificial
  synthetic oligo
catgtttactgtccatcaaccattgtgctattgcaaaagtgactgggggacatgcagtactgctccaaggtacgaggacagtaacccatttggctaggtaccccgtgcctaactctctctccacagcgacccccttccctgccaccttcaccgaaagaggcaaaccataaatcacaggaggtggatattcatgtggagagggacatcaaatatcataacaccaaaagagtcaagtgtgccagtatgtatttcaggcccactggggtgagcaggggcatggagcagccgaaggggcgtggtcaccgttcacggctctgtgtctgcggcccccgtggtctcagtttccgagtgtccggtatcctcccctagggaggaaaacagagtgacaattggacccttgggagccctggggattctggcctggcctgaggttctcttggtgggcttggcggtgagcagtgagagaggcagaggctctcacctgaagcacttggtgaaacatgtcagggctccctggaaccagctcctccaacaccctctcagaagagcaggttccctgggcaagcctggtcctctatggtgttggcaaaataaaccaagggcatagtgtctttagctgagccagttccgttcaggaaaatagggaaaaatcattctagccagcactaacattgcttccttcattcgtcgggtgttcgctgggggcctgttttgtgtacaccaggatcagttgcaggtactggggatacagcaatgaactctagagatctagatcccagctctcctggggctgactatctgccacgctggagggaaatcaggctcaccaggtcctcaagagtttgctcttccttgggaaggctaaaaactgcagctgcccaccttgcaaagctgagagcaccagtctgggggatgcggctttctccatacagtcagatcaggactcagcagcagcaggaatgccagtgaagttcatgttttctgagaagtgcgatgtacatgtggtgtctgaaaggacttattgtcagaggccggcagaactcttcattgtgctgggcctctggctcagggcctgtccccccctgtgaaaatccatccccgtgtccctggcctggatcttcaccctcccctcctgtagatgagtatgctcttttcaagcagttgatgatacattctcgtaaactcccgcacgtgctgagatgcctcattgactagtatcatcgcttccctttcctctctcccgactcccccttgaacccactctaatcagcttccagccccacaacgcgactctcatgtagatgattaaatgacgaattgaaagtgatggtttctgattttcacattactctacttatataagcctaaagacttaagggaagatctatttctgcattgttatctttaaggtttactgaaattcaaaccggggtacttgccaattatatttttccccccaccagctccatcttcatgtcaagaaactcagtgagtagacaaccctgaaactacccctaaattcccagtgagccgaaccccagcattgctggggatccacaatcaaactccaggtttctcttctgtgcattagtggaagccaacgtagggtgcttgagggaagcatggatgtagaaaactgtgtctcacggagccctgagatttttagctataatttttgagtcaggctgctcagtcaaggctcaggctcagcctacgggagccttccaaggtcctggccttgaggatgcccaggggtctgtcaagggcttgacagaacccttttaggaccctgtgatgggccttgagacagtggcatctgagcccccagggctctggtctaggaagcatcagttttcccaccctacttctagttatgattggtgtcaggaggaagaaagaatttggggatgcaccatagggtaaatatattaaaactgtttaatccctgac

SEQ ID NO: 2305 - DNA, 1900 bp, artificial
  synthetic oligo
cctcctccagtgctccccatggtcacctgaggtaattctacagactgccagagtactcctgagaacagtcggaagactgctggtgtcctacagaagatggagcctaaccgtgggccttccagacacatactaatgagtgatgggacctcacattggtcatatcaaatcacattcatctggtttatttcctgtaggggaaaagctgcatctcgctggaacccccagagtggtgcccgcagcatcacagggtgggcagctcaacctttaagccatcccaagggggagcacacgctccaagaccactctcataaaaggctgacccatcctcactgcactgattacaaagagagacttggctttcctgggactccagcatgaggaagtgtaatgagatcatgccagtgagggtcaacgtgggctttgcttgtttctgtgaccctgccagtcaattttattcattcactggccatctttagacacctctagtctcaatcacagaaaatagatgggcatagagagaaattgtgcccaaagaaaatgcactcactcactcgtgggttttaaagtttgtggggaaaattagtggaggagggtttggagggaagtggcattacttgagagatgcttttcataggatagatagaacggtgctgtgttaggctggaggtgggcctggggcaaggtccagaggcaaggggccaaggatgacacccaggtttctggcttgagtgacttgtggccctggggtaccattgacccagatagggatcacaggcggaggaggagaattcagtgaaaggctgaagaaatcgggtctagtcttcggttctgctaagattcatatagctgatgggttgctgagaagctacgttgaacatacttggcaattacacaggaaataaccagaattctaccccattcaggaaatttatacacatcctgttcttgtttcggcttggtttggagtttgtttacatacacgataacacatgtatgttttggtgtatggtgtaaaggtgaggctcaaaactggtggtgctcaaccatgttgggtaatatttgcaggctgtcccaggccctaattggccacttaagggtggacaagacctgtagtgcagagacatcataaaccattggcacacaccatggagcatgggttaggaggctttggtcttggtttacttatccatcaacatcctctggggattgtgaggggagggtgaacagcctcctcccagaggtaggagctagacttgtcttatttacttgctgtgagaactagatggggtaaaacgtgtgggggcatgccaggcaaaacctggtccccagtaacagtgacttcccatatctaccgagaggacaggagctatggattctttgggtggcatttgtaactccactgggaatagtatcatcagtgggcatttaatgattagtagtaatgtcggtgaccatttgtctcataatacacagctctggtatgttttctgcaattgcctggatgagtaatctgttggacttgcatcatgttcctcatgttcttgtttttttgttgttgctgttgttgtgggtacatagcaggtgtatctcactttctaatatcttccagggctgttgggagctttctcattactcctcacagcagtcctgggtggttgagaaggaccgatgctattactctttgtgggagcgggaaagaaagcgtctcacagaggggttgtgaagattacttgggatgccccctccacagagcagctggtgttgtaccaggcctagaggcaacatccatcaggttccttgagatcaggccctttgggataagctctggatgccatttgtccccagatcatcatccagcagcagtcatttacatgcaaatcatgatgatactagcaatagc

SEQ ID NO: 2306 - DNA, 1900 bp, artificial
  synthetic oligo
ccacatcacaagtcataatggaattaagataacagtgagattccacttttcaaactgcaacctgacaaacacttaaaattataatgataccaatcgggtatcatatactgaggttctgacgctggtagtgtgaattggcacagattcacgctacgcgccaaatgtgcactccacatttggagtgccatttgtcagggattaaacagttttaatatatttaccctatggtgcatccccaaattctttcttcctcctgacaccaatcataactagaagtagggtgggaaaactgatgcttcctagaccagagccctgggggctcagatgccactgtctcaaggcccatcacagggtcctaaaagggttctgtcaagcccttgacagacccctgggcatcctcaaggccaggaccttggaaggctcccgtaggctgagcctgagccttgactgagcagcctgactcaaaaattatagctaaaaatctcagggctccgtgagacacagttttctacatccatgcttccctcaagcaccctacgttggcttccactaatgcacagaagagaaacctggagtttgattgtggatccccagcaatgctggggttcggctcactgggaatttaggggtagtttcagggttgtctactcactgagtttcttgacatgaagatggagctggtggggggaaaaatataattggcaagtaccccggtttgaatttcagtaaaccttaaagataacaatgcagaaatagatcttcccttaagtctttaggcttatataagtagagtaatgtgaaaatcagaaaccatcactttcaattcgtcatttaatcatctacatgagagtcgcgttgtggggctggaagctgattagagtgggttcaagggggagtcgggagagaggaaagggaagcgatgatactagtcaatgaggcatctcagcacgtgagggagtttacgagaatgtatcatcaactgcttgaaaagagcatactcatctacaggaggggagggtgaagatccaggccagggacacggggatggattttcacagggggggacaggccctgagccagaggcccagcacaatgaagagttctgccggcctctgacaataagtcctttcagacaccacatgtacatcgcacttctcagaaaacatgaacttcactggcattcctgctgctgctgagtcctgatctgactgtatggagaaagccgcatcccccagactggtgctctcagctttgcaaggtgggcagctgcagtttttagccttcccaaggaagagcaaactcttgaggacctggtgagcctgatttccctccagcgtggcagatagtcagccccaggagagctgggatctagatctctagagttcattgctgtatccccagtacctgcaactgatcctggtgtacacaaaacaggcccccagcgaacacccgacgaatgaaggaagcaatgttagtgctggctagaatgatttttccctattttcctgaacggaactggctcagctaaagacactatgcccttggtttattttgccaacaccatagaggaccaggcttgcccagggaacctgctcttctgagagggtgttggaggagctggttccagggagccctgacatgtttcaccaagtgcttcaggtgagagcctctgcctctctcactgctcaccgccaagcccaccaagagaacctcaggccaggccagaatccccagggctcccaagggtccaattgtcactctgttttcctccctaggggaggataccggacactcggaaactgagaccacgggggccgcagacacagagccgtgaacggtgaccacgccccttcggctgctccatgcccctgctcaccccagtgggcctgaaatacatact

SEQ ID NO: 2307 - DNA, 1150 bp, artificial
  synthetic oligo
acctctgatttgcacacgaatcctatgaatcacagggctgtctgaaaccatttgaaccctcctctctgcagcatacggtacaagtgaccgctcaggctgtgtttcagcacctctaatgttgctaatctcattaccttacaaagccagcgatggcctggctggtgggaaggacatcttcgtgtgagtcccatctgcagcatctgtggtcttgttaacctctttcccggctccttcccctgaccttgtctctctgcaattctgggtccatctagaactctggtgtgacaccccaagagcagatgtgatggctgaggtccaatcataggcttttagtggatatgtattcaggggcaaacacataatgctgcatttacctccacactatgaagatatacagagccttcaatacacatcgattactcataaatgtctacttcttaggtatcaggatcactcttacaatttcatctacaaggtccaactgttaaatgtgagaaaaacagtgcacagtaatgtgacaatagtgtccacatgaatgaagtagttccagtttccctgggactgagagctttcccgggacaggggcctttaagttttaaaaccggaatggtcccactcatggcaaactaggaccatgtgtgaccttggcatgcaatgaaccattcatggccaaataaaatgagctacctgtagaagacctctacacatcatgttctctcgaggaggaccctcggggctgttctgctcagcaagcagaagcgtgactcgagcctgctgggagggccaggaggaagaaacaaaggaaagaaagattggaggagtgggagtaagaaacacaggaacagacggaatgtgacataccagaaatgtatcccctgctggagcacaaggctgtaggagggagggacgatggggcaggggcagaggggctgaatggggcgtggagggggcaggccctcggcctctttgcacccggcagagtgacgagcttcgccggtgtcttcaacgaagtcctgtcggtccctaccggcacatcacacactcctggaagcatgatcttcactcccttccttccacctgctgacctggtgagtctggcttccctccattgtcctggaatgtcccctaggaggttgggctttggtctgtg

SEQ ID NO: 2308 - DNA, 1550 bp, artificial
  synthetic oligo
tgaacaagttcctgtgaaagtgaaatggcccttcatttgaatgcaaatgctatgtaaaagcctgaagccccttgacgtcagcccagccattggtggcctatctatacagggctgctagtcacctggataccctcgtaagaaacgtgggatggagtagcctgaggggtgcaaaagagcttgcggcacaactacgtactgataagtttattctctgctgcttctcaaagtcgagttggggccttacagggacttcaggatggcttagggagcgccttctacccaagacacgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctcc

SEQ ID NO: 2309 - DNA, 1000 bp, artificial
  synthetic oligo
aacactaaatgcaacttagttaaaaatttttctgtcatagccatacacactatattctaaatacacacacataagcacattagatacatattcacacacagtagatagaaacacatacagaggaaaaaaatatatatatatatatcctatgtctttcctagacagccttttctgactgaaaaagtatacttttgtgccaatcagagaaaatttcagtcacctaaaaacctcataaatggagaaaatctgtccatagtaaaacagcagtctgaagctctgtggggtaattatggcctccagggctctaccaagtaaagaaagctgtggctgtagctttcatactagcagggatcaacattcactgaatcacatatgtcactgccagttgtgtcatttcccatgtaggcctagctcttagttgttaggaagtcttgctgttgcaccagttgcctgtgtgatggtttgcctaaccccatcctcactctatcagaaggctttttcctctaacctcacatcattgggtggatttgctgggggagagaggctcatggagatttggagaaattgctccttccttagaaggttcagggttggatggctcacctcttttaatgctgtgacccaatcggaaggacagatgcaaagactggaagaaaagaacaggaataaattggaggtattccaggatgggaagtggggagagggtagaggaaagcttaaaggagtttttatttctccatgtgggatctgcttcctcctttttttttttagacgacgtcttgctctgtcgccgggctggagtgcagtggtgcgatctcggctcactgcaacctccgcctcccaggttcaagcaattcccctgcctcagcctcccgagtagctgggattacaggcatgcaccactacacctggctaatgttgtatttttagtagagacggggtttctccatgttggtcaggctggtgtcaaacacctgacctcaggtgatccgcctgcctc

SEQ ID NO: 2310 - DNA, 1550 bp, artificial
  synthetic oligo
aaatcaaaaccacaagatatcacctcacacctgttagactattatcaaaaagatgaaagataaatgtcagtgaggatgtggagaaaagggaacactagcacaccaatggtgatactgtaaattagtacagtcattttaggaaatagtatgaaggtacatcaaaaaactaaaaatagtattacccacccacagctccaatagaaaataaaaaacagaagagggaggataaaattggcctataccgcctcctctaattgcagaaacatctgtaccacctccttcagtggcagaaatagagaccttaatacaaagaattttacactctgctgccatagctggagaacccttaggaccttgcgcttttcctatttctgtaaggcctgatccaaataatccacagcagcttattcatgaacacactccactagagtttaaagttgttgaaggaattaaaagcaagtgtggcaaataatggtgtaaagagcccattcaccttaggattgttagaatttgtgtttggtgctttgcgtcttttaccctttgatgtgaaacacttggcgcaaacttgcttgtccactagtgcatatctgacatggaatttaaattggcaagaaatgtgtgcagaccaggctaaacagaaccgtgttgctggacacgcagacattacagaggatacgctacagctatcagtccctgtcttaagcaggcagcattagaaggagagctcttaacatgctcagtaatgcaaaatcggcaaggcaatcaggtgtatgtttataaaaagataagaaaaagacattagaagtcgaaaccacttggccaagcaggcggtgggcagaaaaaaaggctcagcggcagaaaagtttgcagcaaccaagccgacaaggtccgcccaggccggcagcatcccccaccccaccggcaaaggagggagtgagtggagcagacacaggcaaagcctaagcaagtacaacgcggctgccgcccaagacctgcaaccgctgccctctggctctgagggcagcccatagcaaaatttcatgtgttacatcccaggctatgattgtttgctaatattttagtaaaatgtaagaaattgaaaaacctcttttctaataatggccactattgttatcgctctcctacccctgacgtagctttccaaattcaatttaattaaaacagtaacctctaaagggagagagattacagagggcccatgaattagttaaagagtaattaaaagctaagcatgtaaaaccacacattaccctttaaaagagaactttaaacctaattaaatgatatttgttaaattagaaggtaaaaatgtcatgtccttctcagaaagtgaagaaaagttgtatgtaagtgtactgaaaactcatgcatgaacgactgtcttaactcactgattacagatagtctttgatttgtacttgctaagagagtcctaaattgagttccccagctagtgagtcactgttttcaagactgtttgccagattaaagtccataaacttggtcagcctgaaaactcaattacaaga

SEQ ID NO: 2311 - DNA, 1000 bp, artificial
  synthetic oligo
ctaatttttgtatttttagtacagacggggtttcaccatgttggccaggatggtctcgatctcttgacctcgtgatccacccgcctcggcctccccaggtgctgggattacaggcgtgagcaccaccgtgcccagttaattttttatttttttgtggagacagggtcttgctatgttacccaggctggtctcaaactcctgggctcacacaatcctcccatctcggcctcccaaggtgctgggataatgtaggagccaccacacctgcccagagaagaagggttttaagccagaagagtattatcaatccacttctaaactgtcaagtgggattacagaagggatgatcattgctatgtacatcaaccatgatatgccagggcagagtgaagaaggatatgtagggataggtgatcagaactggtttctgattcctgattccagtgagcatttcactttgtacccaccaattaagtctttcctaaagaattcaaggactttttcccccagctcaggtattacactttgctattctatgcttactaaaggccaaattccgagatttaaaaaagaaaaaaaaaaacttcaagatcacttaaatagaaaatgcaaggggcaggcatgagggctcatgcctataatcctaacactttgggaggcggaggtggaagaattgcttgagcccaagagttcaagaccagtctgggcaacatagtgagtgagatgctatctctttaaaaaaaaaaaaaaaagagagagagagaaagaaagagaaagaaagaaaagaaaatgcagtcatgaattatgttcttaagtcccagttctgccactgattacaatgtgacctaaagttacttaagctttccaagactcatctttgagatggaggtagtaataacacaaaactaactctttcagttttttgtaaaaattcaacgagacagggtacataaagcacacagtaggtactcaatgaatggcatcaaattattaaaaagct

SEQ ID NO: 2312 - DNA, 1400 bp, artificial
  synthetic oligo
taaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttgg

SEQ ID NO: 2313 - DNA, 1150 bp, artificial
  synthetic oligo
tggatgaccagaaaggaactcttgtttttttttgtccctactttctcacaaacagtctctgtctctgagctgagctgtctggaggtgggggtatggtgatggaagcactcctgtggccaccatccctgagactgcacttgttcatacctgaagccagcacaacactggatcttacccaaggtctgctgaaaccactacctggctaccacccacatttactcaagtccttgggctctacaaccagcaggtggcaaagtcagactgtttggtgtccttcccttcagggtgacaagttcctccatgccacaagctggtcaggagatgttgtctgggtgccagggattggagttaaaaaaacatcagaaattagcctgatgttctatcctactaaatagataagtggctaagctggtgctaaaaccatgacatgcagtctttcccactctttcttcttctttccacaggcagagaggcctctccctgtcaccatcaccaccacttgcccatggtgggggaaggaggagggcgggcttctgcctggccactgccaatgttcccttaaagcctaaggcctcttcagttagcttgtgctgaatactgccaggcctgtgactcacccttcagggctatggtctgacccagggcaggtccagaaatgccatccaggagcctaggcctagactcagggaacccaagagcctgcttgttgctctaccccactttggtcaagttggtacctaaggtgcaagacgaagtcccctttacttttctgtctgcttttctcatacagaaggagttgtttactgtagacaacacagctgggaatgtgctggatcacatctgtggtcagaacgtcttagaacccaaagcccacagcatactactagggtattggtgctggttattcaggtcccaagagctctttagttagcaggtgatgaatcctgccaggagtgagtccttccctcaaggcagcagtttctcttttggaccaaggtatagctagaaatgttgtccaggacctaggccctggaataagggcctcacgactctgcctggtaccctaccctattgtggcttagctggtatccaagatgcaagacgaagtcctctttcatctttgttttcctccccttaagcagaaggaagg

SEQ ID NO: 2314 - DNA, 1650 bp, artificial
  synthetic oligo
agttggaaagcaagaataaaatgacccttttttcaaatgttttctgtaccatttattgcattgtttacattttatgcatctcatttctaaatgaactcatggtaacagagactgtaacacttttgcatcaccggaatcttctaggtgtgtaaaatgatggacgagtgaatgaataaatgggggagtggttcagagcttggaatggcgctatgaaggtggtgaagtgacgtccctaccccctcaacacacatataaaaattatgaatttataaacattttcctcttgatgtaatttttcaatggagggaagaggataaattcatagttctggcacttacatctggaattaggctacacagtctacgggaagcaagttaacacagtctaacagatgcacgtgaatttcatgctgggcgaagatgaactatgtggaagatgacttataaggagcttttatgttacatcttggcagttaacacagtctaactgatgcacgtgaatttcatgctgggcgaagatgaactatgtggaagatgacttataaggagcttttatgttacatcttggcagttaacacagtctaacagatgcacgtgaatttcatgctaggcaaagatgaactatgtggaagatgacttataaggatcttttatgttacatcttggcctgaggttaggaaactaaagatgacaaaggcactgttttagtatgggttttctggtttcgcttttgtcgtgggggcggggtgggatagtggactcgtaccctaacaaagacccactcgaggctgcgtgtcggcccgggggcagcagggggcaggagaagctggctctagaccacgcgttccttttcacgtgaccagtcgctctctttcccgtggcggccctgcttccggcaggggcatcacccggaagtgggggtagtcgagggagggaggggtaaaggcggctggccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattg

SEQ ID NO: 2315 - DNA, 1400 bp, artificial
  synthetic oligo
ttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggt

SEQ ID NO: 2316 - DNA, 1450 bp, artificial
  synthetic oligo
tgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgat

SEQ ID NO: 2317 - DNA, 1000 bp, artificial
  synthetic oligo
aaatgtagaatttgttgcctccacaaaattgaaaagggctgatttagtgctatgcctgttttttgtggtatgagggagcagatacagcaacttatgttttaccttaggagggctatttcaacatgccccacaccactagacacctagaaattttactgagatagaagcctccagttattttgtggaatgtattttcaactttctggtacgcaaatgtcttaatgttttgcctagagttattcttacttcctgctcaacaactccagtcaacataatattatcagtgtaatggaccaccatgatatccctaagtctgtgcaaaggaaaggtgatcaaggacactatggactaaattatataaagatggagagttgctacaatcctgagataggacagtgaatgtatattgctgaccttgtaagctgaaagcaaactgtttctggtagtctttactagcaggtgcgagaaaaaaaatgcatttcctagaccaaaagatgcaatgtacccaggactgggctacttgtttaaggaacaaaaccacatttagaacagaagcttcaaataaaatcaccactttattaaatttatgataatctctattattctccaacagtcatctgtttcttcgtaggccaagtaggtgagttgaatgggtatttggtgaaaaccatcacccctatatctttgaagttttttttatgatggcactaatctgaaatgttgctaggaatgtgatattaattttggtttattattttcttatataatggcagttctagtggcttccatttgagttttctaccataactgcccacattccattggttatgaataaatgtggggattcttacagttgctgagtttgtctatccaaattacacattctgaaagttgggaaacaataataggatgggtttggggacctactgggtgcactgtaagatgaacctgagctaaaacttcattgatcaactgacttctataaacctctattctaatt

SEQ ID NO: 2318 - DNA, 1000 bp, artificial
  synthetic oligo
cctgataccaaaacctggcagagacacaacaaaaaaaggaaattacaggccaatatccctgatggacatcaatgcgaaaatcctcaataaaatactggaaaaccaaatccagaagcatatcaaaaagcttatccaccacgatcaagtctgcttcatccctgggatgcaacgctggttcaacatatgcaaatcaataaacgtaatccaccacataaacagaaccaatgacaaaaatcacatgattatctcaatagatgcagaaaaggccttcaacaaaattcaacaccccttcatgctaaaaactctgaataaactaggtattaatggaacatatctcagaataataggagatatttatgaccaccccacagccagcatcatactgaatgggcacaaactggaagcattccctttgaaaactggcacaagacaataatgcactctctcaccactcttattcaacataacactgaaagtactggccagcgcagtcaggcaagagaaagaaataaagagtattcagatagaaagagaataagtcaaattgtctctgtttgcagatgacatgattgtatatttagaaaaccccattgtctcagcctcaaaactccttaagctaataagcaacttcagcaaagtctcaggatacaaaatcagtgtgcagaaattataggcattctttttttgttctttttttgagacagagtcacaatctcggctcactgcaatctccacctcccaggttcaagcgattctcctgccccagtctcctgagtaactggaattacaggtgtgtgccaccagacccggctaatttttgtatttttagtagagacggggattcaccatattagtcaggctggtctcaaactcctgacctcgtgatccacccacctcggcctcccaaagtgctgggattgcaggcgtaagccaccatgcacgtcctacaagtgttcttatacaccaacagtagacaagcagagagcccagtcatgaatga

SEQ ID NO: 2319 - DNA, 1300 bp, artificial
  synthetic oligo
atggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattcca

SEQ ID NO: 2320 - DNA, 1150 bp, artificial
  synthetic oligo
taggccctgaagtctcatttccttcttcatgtccatgtgtactcaatgtttagctcccacttataagagagaacatgcaatatttggttttctgttcctatgctaattcccttaatataatagcctccttgcagctaacaagatggccaaataggagcagctctggtctgcagctcccagcgagatcaacacagaaggtgggtgatttctgcatttccacctgagatacccggctcgtctcactgggactggttagacagtgggtgcagcccctggagggcgagtacaagcagggtggagagtcgcctcatccaggaagtgcaaggggtcagggaactccctccactcacaaagggaagctgtgagggactgtgtcatgaggaatggtgcattctggcccagataatgtgcttttcccatggtctttgcaacctgcagacaaggagattccctctggtgcctatgccaccacagccctgggtttcaagcacaaaactgggtggacatttgggcagacaccgagctagctgcaggagtttcatttcatacaccagtggtgcctggaacaccagcgagacagaactgttcactcccctggaaagggggctgaagctagggagccaagtgatctagctcagtgcatcccacccacatggaacccagcaagctaagatccactggcttgaaattcttgctgccagcacagcattctgaagtcaacctgggatgctccagcttggtgcggggagggtcgtctgccattactgagtcttgagtaggcagttttcccctcacagcataaacaaagctgcccagaagttctaactggtcagagcccaccacagcttgaccaagccactgtagccagactgcctttctagattcctcctctctgggcagggcatctctggaagaaaggcatcaaccccagtcaggggattataaataaaatgcctatctccctgggaccgagcacttgggagaaggggtggctgcggatgcaacttcagcagacttaaatgttcctgcctgccatctctgaagagagcagtggatctcccagcacagtgctcaaacactgctaagggacagactgcttgctcaagtgggtccctgacttctgtgtctcctgattgggagacgcctccca

SEQ ID NO: 2321 - DNA, 1150 bp, artificial
  synthetic oligo
cacacctcgacattgccccaggtaatgttagcttgctcattataccttttcccttttgttttcttaaattcctccaacctgggacaaccgtaggaaagtgatgtgggaacttttaatgtagggggacccagcaggggcttcgtttcacccaacctttgatagtgttgtaaagacgtttgctttaactccatcaattttcatttcatttcatttcttaataaacatttaatgattttcaccattctgggatgagtcctttgactcccttttgcctttcccttttttgttgttgttaattactgtaatgttctattagcatctgtaagacccgtgaaggacagcaaatttgatagggcttctcaaacagttgtttgattctgcaggagtaatgtcatccagggtgcccatatagaaggggcccccttaaccacaacttttaccatgacctggataataggcatatacagtggagacatatcttggttatcataaagccagtcctacatggcttgcacataaggaatatcagctgcttcatctgggatgctccacttggtattttatagagagagttgggaaatccccttctcagggtaaagagaccttacagtggcattcatccattccactgggctgcttgttctctcacaaataaactgctcttcatctggatcacatataaccatcagtgattgtctaatagtaagctatgggttctgtaacaacccaaacatgctctttcattctgtagcatttaaaatataagatactgcccttaaagtagttatttttacattctgttatagtaaagggttctcaggaagtggatgacacaaatctacaaaatggaacaatttctttacattatactctatggttggttttgcccttccctcacattgactatcttcttggtaaccacagattttagagttagtttctgttgccctgcgtaattctgcccttggggtgcagctttcaggctggtggcataaactcagattgacttaaatctgagctctgtctagcatcaaggtccaactcagcactattctttttttttttttttaagacagagtttcgctcttgttgcccaggctggagtgcagtggtgcaatctcagctttctgcaacctcagccccctgggtt

SEQ ID NO: 2322 - DNA, 1150 bp, artificial
  synthetic oligo
ctaaatatgaccagtctaggaaagaaccttcttctcttccttctcaggtcttctagctccttgtcatctaacccaccgaacaaacgtggacgtatagcttccagagcccgtctaacaactccatttccaaaagtcatctccagaagacatgtattttctattatttattttaaacaaatgagaatttacaagacgtgtgactttctaactctactttatcatacgtcggcaacctctttccatctagaagggctagatgtgacaaatgttttctattaaaaggttggggtggagttgagagcagttttttcatattatatacacaggccttccataaacggccagtaaatcttcccagagggtggtgggcatttccaacgggccaaacgtggcctgtcattctatcatttctctctttcgacagcaaggtctggtagaacgaagaccaaccgcccgatggccgctaacagttccacccgtcgccgtctgggacttcgctcacctaccaggccggttaagccctttgtccgttgtcttcaggactaggtaggtctcgcccaatggcgacagagtggtcacctgggacccggatctgcgcggctccgtggcctaaagaggcggcctagcctgcctgcgtccctgggccgctttcccgggccctccacgccctaacagcctccgccgcgcggcgttcgagcggccgccatgcttcccggccctccactcctgcagccgcccaaaggcgctgcgtcccgacagctctgcggaggtttagcggaggcccggtaggcttgggccgggggggttcgggctgggagaggccgcccccgccatcagtcaccgaggtgggagggggggaagagaggttcgctgtggcttcaaggcctgggcacagccagtgggcagccacagcagaggcctccatccggtatctgcagggcagagggctcagactgtcccggggccccccagttcacccgccggccaggggccggagggcctggaggcccctggagtagcaggccgcattcttcgtctctccgcgctctctgccggacctgaactcacaaaagtgaactttttataaatagaagtaaaagccaaaaataaaatggtgaccttattttacacacagacacacacacaacca

SEQ ID NO: 2323 - DNA, 1150 bp, artificial
  synthetic oligo
aatgtgcaaaagttactgatattcctatgcaacaacagttaagctgaaagccaaatcagaaaggcaatccctttcacaatttccacaaaaaaaaaaaacaaaatacttaggaatacagctaaccgggatttgaaagatacttacaagaagaactacaaaatactgctcaaataaatcagagatgacaaaaacaaatggaaaaacattacatactcatggataagaagaatcaatattgttaaaattgccatactgctcaaagtgttttaatagattcaatgctattcccattaaaccaccattgacactattcacagaactagaagaagctattttaaaattcatatgaaaccaaaaaagagtccgaatatcctaagcaatcctaagcaaaaagtaccaagctggaggcatcacggtacctaacttcaaactatactgcagggctacagtaacgaaaatagcatggtactggcacaaaagcagacacctagaccaatggaacaaaacagagaacccagaaataaagccacgcagctataactatatgatctttgacaaacctgacaaaagcaaacaatggggaatatattccctattcaataaatggtgctgggataactggctagccatatacagaagatagaactggagaccttccttacaccatatacaaaaattaactcaagatagattaaatacataaatatgaaatccaaatttatgaaaactctggatgacaaccgaggcaatatcattctagacatagaaataagcaaagatttcatgatgaagatgccaaaagcaattacaagaaaagcaacaattgacaaatggaatataataaaactaaagagcttctgcatagcaaaggaaactgtcaacagagtgaccaagcaacctatagaatcagataaaatttttgcaaactattcatctggcaaaggtctcatatccagcatctataaggaacataagcaagtttacaagaaaaaaaaataaccataaaaaagtgggcaaaggacataaacagacacatttcagaagaagacacacatgcagccaacaatcatataagagaaagctcaacatcatcgatcattagaaaaatgcaaatcaatacattatttttaatgtaagtacattatcataa

SEQ ID NO: 2324 - DNA, 1100 bp, artificial
  synthetic oligo
agccctctccaaggaaaactaaaaaattctaatgacacaaagtgaagaggatgcaaactaatgaaaagacatcccaggctcacagatcagaagaattaacatcattaaagtaagaagactgcccaaagcagattgagtgcaatacttatcaaaatgcaaatctaactgacgcctgatgatcagaggtgacattctttacagaaatagaaataacaatcctcaaatccatatggaaacacaaaagaccctcaataggcaaagcaatcctgaacaaaagaacaaagctggaggcatcatactacctaacttcaaaatatactgtatcaagctatagaaaccaaaacatcatgtcattgatataaaaagacacatagactaatggaaaagaacaggaaacccagaaataaaaccacatatttacagccaactgattttttgacaaaggtgacaagaatatacatagggaaaaggataccttcctcaataaatggtgctggtgttttactgtcccttctgtatggagctttggacctgaaccttttatgacacttcctaatcagtataaatgtaaatttgcatagtacacaaatgcattcacagacatacacatatagacatgcatgaataataagagagaccattgatcagcatgtttcatgttggccacttgtggacagtgatttcatccaaaaagaacatacgttttaaacatctgagtagtttaagttagaaaaaaatgatgaaaggaaaacaagaaaacaggataagtgtcctccaaagagcagtagctgatgaccatacgttgtaaacagcctgacttcgacagtgagcgataggggacatgtaataaagcctggtagaacccaagaaatccagtgtgtccacaggcagacaggtgtatagtatggaccgatgtttctacaatttagggtgaacctttctgtccccagttagttgtgaaaatagtttttaaaaacagttttagccttttaagagtaattttctagtcccttctgtgctttgaaatgttaaggatcaattttaggggcaagttccctgttgggagatccttgttttcaggatttgaacatgtgaatgac

SEQ ID NO: 2325 - DNA, 1000 bp, artificial
  synthetic oligo
cggtgaaccagaaaaacacattccttgccttcttggagcttacacaattttaaataaaagaagtaactgtaatgtgaataatttaacttaagtgattctgtaaatacattagcagcaaatatcataattgttttaaaaactcaaataatgaaaaaatcctaataattatctttataagccctggagcacagtggactattgtaattatcaaaattatttatatctgttgacatttactatatatttaatatgtttactgcaagtatttagtgtggttataattactgtctatctggctctctcctataccatatgtcttcaaatttagaaatagcgtgggcatgtactgctccttaggttaatgtttcctcatttctggatacggagttcattggcttcactttgtgtgtgtttttaaagaagaaaacttgtgccatctgggagaaaacagacttcaaggaaagaggtcaaaaggtgcttaaaatatttacattttagcagaaagagtaaatacatgttaatgtcaagaagaaagctttttaacatagcttagtttagtcaattatcctggtttcttttatacagagtgacacattttaaagaagcaactatttaatcagcaattagccttagatatagtaggtattttggaagtaggcaatggagatgaggatgaatgggattttaaggaagcttgacatgaacatcaatgttgcctctgggctgtaaccaaggcacctctctgtctccactctcttgtctgccagcacttgccaggttccaacagggatgtgggaatgggcaagagtctgtgcgttttagatggtgggtgggtgaggacatgtaacagtaatatccttttgttagtggtggaaggtatccaggttaccagtggcgaatccgtatgggtctgtagcaacctcaattcttgcctcctcagaagaaagaattcaactgaggggcgtaaggcagaaaaacagactgaggcaagtttcagagc

SEQ ID NO: 2326 - DNA, 1300 bp, artificial
  synthetic oligo
tttcataatgcaatcacaagtgttagtagcagaatagaccaggtggaggaaagaatttcagagcttgaagactgcctttctgaaataaaacagacagaaaaggatagagaaaaaaaataaaaggaattaacaaaacctccaagaaatatgggattatataaaagaccaaatctatgactgattagtttatatgaaagtaatgaagagaacagaaccaattttgaaaatatttcaggatatcatccatgagaactttcccaaactagctatacaggccaacattctaattcaggaaatgcagagaatcccagtaagatactccaggagaagatcatccctaagacctatagtcatcagaatctccaaggtgaaaatgaaaaaaagaaaaaaagttaaaggcagctatagagaaaagccaggtcacctaccaaggaaagcccattagactaacagtggacccctcatcttaaaccctgcaagccaggaaggatttggggccaatattcaacattcttaaagaaaagaaagcctaacccagaattttatatctggtcaaactaagcttcataagtgaaagtaataagatcattttcagacatgcaaatgcggagggaattttttaccaccagacctgtcttacaagaactcctaaaggaagcactaaatatggaaagaaaaggccattactagccactacaaaaacacactgaagaacagactagtaactctataaaggaattacataaaccagtctgcaaaatagcaaaataaccagctaacatcatgatggcagaatcaaatctacacatattactactaatcttaatgtaaatgaactaaatgtctgaattaaaagacacagagtggcaagctggaaagagaatcaagacccatgctgtcttcaagagacccatcttgcatgcaatgacatgaataggcttaaaacaaaggcatggagataaatctactaagcaaattgaaaacagataaaacaaaggttgcaatgccagtttccgacaaaacagacttagacacaacaaagatcttaaaagacacagaagggaattacataatggtaaatggttcaattcaacaagaagatttacatattctaaatatgtatgtgcccaacacaggagcaaccagtttcataaagcaagttcttagagaccttcaaagagacttagactcccatacagcaatagtgggagactataacactctattgacgatattagaaagttcatcaagacagaaaattaactaaggtattcaggacctgaactcagtactggataaa

SEQ ID NO: 2327 - DNA, 1050 bp, artificial
  synthetic oligo
aaaacaaaggaccaaattatgaatagacaattatgctacaaataaagcatctaggagaggaacactagagtccagcagagaagtcatgggaaacacctgaagcacagaaaaagatggatgtcagtagccagctcagctgacattggctgaagcctagaggagcttgctattgcaggtaaagagtaagtgaggaaatgttagtagtccacatcaccaccattaatagttgcaatccaaacaacagggagagctccgctacccacagaaatgctgactaccattgtcagtaatctggagaccctgtaagagcattacaccagacaggggatgtgttcttggtcgctcacaccccagacacctaagtggttggatcagggcaccattgtgagagcatagccataatgggactgtatcctgccctggggagccacagcctccatatctccacattctgggagctccaacatatatcccccggtgttacagctacagtggtacagtgctggctgaacccaaaggtgtcacaggattctcaagactctagccaatagggagtaccactccctgagaatagaacagtgcagcacaccaaaagatgaccaaagcacatgctttccagagcccaagagctctggtgctgtgaaaagagattcttttcccagcagtggcacaaacttttgcttggactggcaggcaaacagtatgatcccctctcccacttggcactctgtcacagcagttgctgcaactagaaacccaggttggtgagtctgaaagttgaccctctgaggctggaggaagtgactctacctcaaccatcacagtggcctctgtgctcagtctcctctgtagagagaagtacccccttttcttctctgcacaccgctgcagccacagatgctgctgctgctaccaaggactggggtgaatgagcaaaattgctacccgcctggggttgtgagtagtgatagtcctcccactggtggcatggcctcagtgcttgggctcactcacaaagagtggggccattccacacctttacatggtgct

SEQ ID NO: 2328 - DNA, 1350 bp, artificial
  synthetic oligo
tgcccaccgctggggtaatttctaggtatgggcaggaggggtctgggcagtatggcttgctgcccggcaggatactgataagatgttcccatgatgaggtggttctggcccttgtaccggcagaatgtggtgctcctccttgtactttctcccagcagaatatgataagaggcaggctgtttcttcatttgggcctttgtccaccttgtggtcaggtggttaggcaggttgtttctcacggcccgaaccccagtgagatgtttcactttgactgaggcctgctaaataatggggagcttataaaatggtgcagtttggactaacattcttgccttttactttaatataaaagaaagtggggcattttttggttatctggctgtttcctgctgaataacggcactgtaatcagggtttgggttttgaagtagtggatgtctgacttcagagttgttttcctggaggtgctgacaccagacttggtggaggagaaagatggtatcaattatttttgggtggctgcctagacaagggagttcagcctttgggagataaagtagaatatgaaggcgattatacatggaccgattgttattattatgaggaagaaaatcaggggccctaagaaagggggattcactttaggaggaatgactcctgccactaagagtcagtgtcatgatgttggatttctgcagccgtcatggagtctgtgggctgtgcagttaacaatgccagattcattaacctaaaaacagattcttcttggagatatacttatgtaccccccccttctcagcagatagcaggtttaaggccctttggttttggaagatgactcccacaaggaaatttatctgcctttggagtctcgtaatggaattatacatgtcctttagggtattatagaggactgtagatattttttatatagggcagttgaggttgatatatttgctattctggtagcaagtgcagaggagatgtgtattcctgtttccagaggaatgagatgtagaacccacatagtgcatgtggaggaagatgagacagaagttactaaaggaacctggatgggctggttgtttggcaaaatgttaatgtttggagattgacaaaccagggtgcacgttcctgacccacctgccagtaagcaagataagagtttgtgtcacccagaaaagactggaggttgacaggcaaaagttgtaagtgaaggtagcaagccatgagaaggtggcggttgaatcctggaaaaaatttttgtctcaacctttttgttttttctaggttgaatagctgttaacaacggtagccactatgagagcctgatagggaatgttggtggag

SEQ ID NO: 2329 - DNA, 1350 bp, artificial
  synthetic oligo
ctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaa

SEQ ID NO: 2330 - DNA, 1150 bp, artificial
  synthetic oligo
tttgtctaggagattgagatctccatgctgagtgaagtctccattttattcccaatgctttgtttacttgttgagttatttcagaggtgaatgaaggccaattattactttggattacatcagagagcccatattgtagtatgttgtttttttttctgtaaaactttaactatattggttgcttattggatgtgacctgagtatgcttcagagaaagtgtccactagaactaggaggtatttgtatctcccaggggctggtggcctttgtgtaaagtctatttgccagttttctagggggtgccttcctcttctttgttgcccaggctgcctttggctgtgattattaggctcatttccggcacacagatgacaatgctgaattatatcctttaagtgggcttttagtcctttccctttcaaataattttgtacaaaggacagtgaagtgtctcacccaaaatgcatactattgtgattgcgctttaacagtgggtagacaagatgcactggttcctggactgggcctgctctgcttactctctactcttcctcgtttagtttgaatcccttacggctttcttatcttcagaagtgtactggggcttggaggctaagtttatttgtggaattaagggcacccggatttcaatgctggcactagctaaatgccttgtggtgaggtctgcaaaagcgttgctccttgccatttcagaattattgcattgatggccagggaaatgcattacagctatttcccatgcggcctttatctcttctaacaattctaacacttgtttagcgtattcaactttgatgttatccacctttagcagccctctttccctccagatagctccatgtgcatgaagtatcatgaatgcttggtacttggagtcagtgtgtatgttggcactcttaccttgggacagttgcaaggttctcctgagggcgtttaactctgccttctttgccaaggttcctgccagcaaagttattgcctctgttacttctgaggaggtcaccacagcatatgtaggatttctcttcctgtcagggaccaggctgctcccgtctacaaacaaggtccagtctgagcatgggagctacctcctttaggtccaggtggctgaaaaacacttggtctatga

SEQ ID NO: 2331 - DNA, 1050 bp, artificial
  synthetic oligo
actgccatctcctcagatgtggccaaacaatgtacttccacactagaaagagcctacccatggtccccaccaaagtaataaaagaaaatgatgaaaacatcatttcaggctttgctaaaactttccaagtcctggtggaatagaagagctaagaggctctgctgggtttgtatagatatccagtcacaatggatgtgtttgataatgctggcagttctttactgtgattcagagtttgggtgtattaactcaaagatcctaatgatcacagacgaaaatccagcactaaaatagttcaaggttacagttacaagagcaatatgtttcctcttcagaaataatctgcaatcaatgaatcagaaagaaaaaagttaaagtgagttccagttcctgagagctcaagtagttggctacttctaagtggcagcagtagtagaaccaacaagcaagtgatgtgtatatcagacaagcttcctgaattgtactcttatacatctacttagtttattctgcatcacctcatgaacaagacaatctgtaaccaaagcagggccattttttgtgagatataatggaggagattatgacaatgattatgaagaagtttagtgctgttaaaattggtcacatgtgcctaatcgaggaaacctaattgttgagaagtacaccacccacccttgacctatctaactcctactctatgaagcagagataactaattgcctgccaaatatctttatctgtttttgttaaatagaaacaaagccccatttctgttaggaatggcagtgtgctcagctaaaagaaactacatttcacaggctcccttgcagacatgtaacataagattggaccaacattataaagcaagatgttaagaaaattccttaaaaggggagagctgacttaggtaagagactattttgtctttattccttcctgctttgtcctgtctggaatggagacataatgactgatgctgcaacatctgtctgactaccatgaggcaaccctgaagatagaagccatgtgcctgtgggtggcagaata

SEQ ID NO: 2332 - DNA, 1100 bp, artificial
  synthetic oligo
ggatttaaaggagcagttggttcagctcctccttggtctgcaggtttttcttcctttaaccctcctgctgcccattgatctttctgtcccttattttgtgagacacgtggagggggcaagcataatagggggtcccagggcttttcactgggcaaagacttttttttttgagacggagtctcgcactgtctcccaggctggagtgcaggggcacaatctcggctcactgcaagctccgcctcccaggttcacgccattctcctgcctcagcctcccaagtagctgggactagaggcacccgctgccacacccggctaattttttgtatttttagtggagacggcagggcaagggcttttcactaggctctttttcttctttgaggggaaacatgggggctaattccttgatccagcagagtgtaacctatcttttcttgtgattatggggttttatcatttacatagagaattaaagcttggcacactcagtcatcatctgagccaaacttaggccaaaagacggaaggcttatgaatggggtctttgggccagataaaacagcaatatattattatcttttgcttttccttgtccccagtttgagggtcatccctccaaatctgcagcattctcccaaaggactatccggggaaatgtcagagggaatctctttggctccctcttttctttgtcccctaggcctagaatttctgtttcccatttttggtcagtctctgtatctgagcttttctctgtgtactcggcccccacactggaggtttcttgcacacccagagaatcgctttgtccatctccaaccatctccctcacaggagaacagaaccacggattgggactccacactcgctttgtatccaggatacgtctcagtcacacacactcaacctccgaaaatgcccaaccaccaaggcggtacttatagtccaattttcctaccttgacttgtgcatgaggttgcctggttgccacagtgcctgctttattccctgtgtcgcctacgctgcctcctgaataacagtcttaggtttgtctctggcctctgtggggagccaggatgcctggacagagcaggccacc

SEQ ID NO: 2333 - DNA, 1250 bp, artificial
  synthetic oligo
aaaaaaaacgtgattttatgagttccagaaacttcccccgtcctctccaggtagggatgggcacagggtacaaaggactggtacacaaaagcaagcccaaggatagactggcgggagtggaggcataccatacttacctgcgaaacactcctctcttacgaagcagtgaaaagaaagacactattatgcaagtgagccctcaaaggggccgggcaagccttgcttgcctttgcaaaggtccagggtcaccgtctgcgtgctctgggggcttaaggccccacctcgcctcccgtatcgaactcgaacgctggtacgtctgggtcccagctcagcctctcggctgccttcgtcccgcactccgaccccagcgccggcgagatgcctgagctctttgttcggggcccagtcactggtcgccggcgtcggggtcccaggcgcgatggccgcccaaaccccacaccgttcccgacctgagctcccgccgctcagggtcacaccccccacaactaaaagcccgggatcccctgccggccccaggcgccttcgtctctcacccagaaaataaaagtgtagattagcagaacgctcttgaaacaagtaatgactggtttagtctgcagtctccgagacggggacgccatgactagcccgagaccctgcaccaccgcaccgggcgattggaacacagagagcgagacgcggagtccccgagtctccccggaaactgccgaaaacttacgagcgtccacaactgagaagggccggaaacactgtacaattttgtagagggtaaagtatgggaggctgtccggaaagtggcaacaatttcagagcgccccctgccgaaggttaccgaaaactatatacaaaggttctagtgtcggaaatttcataggtcttcaagtggagctttcttcattgttttttttctatcctaaggaatctttcccgccccccacccctcccctctccttataacttcaccatattgtttctatcaccagcagagcccgcagcgctctgagattgggcctccctggcccctggtgccctagagagaaggaaaagaatgaagaggttaaaagcgacctaagaaaatacatgggaaaatacccacaagaaatatatttgcaaaaagaaagcggattgcaaagcaatacatacagtcacgtgtgcttagacaaaaactgaaaggaacagtgaaatttacctctggtggaattaggctgatttttttctcacttgtgtgc

SEQ ID NO: 2334 - DNA, 1100 bp, artificial
  synthetic oligo
agctccctttaaccttatctcttcttcaagctattctccatgtctctactttctttcaccatcaattatcctgaggaaaaaaagtccacacttaccacctctacttctttgcccattcactcagcctagtttctagtgaaatctggtttctgctttcactgatccactgaaaatgcaatctaatgccaattggccatgtcttctcagacctcatctggtctgacctccctgtagtatttcaatactgttgataacctccgccccttcttcttgaagctctctcctgataaccttttacttcactggtgtttctttctctcttcatcctttaaaatgttgctgatctctctggttctatacttgcctctcttctctagtcatgctacataccctcattggggatttcattgattcccccaaaccttctagatgtgactctgccaaaggtatattttttcaaagaacgtaggccacacattgccaagggatcaagtgaaactctttatcattaagttcaaggccctcttcagtcaggctcccacctcatgtccaactccagccccacacctacatctagtgtaccagaactccagtcccactaaaataagggacacactcacatacaaccccacattaccatgcctttttaaaacctttgcgcatgttatcccctcttctgaaaatgctcttctctcctcatcctgctccttttctgtctggtaaagttttaagatccagttttaatgttacttcttcaaagctctcccaaatgtaaccagacataattcaccactcctatatctgtgtccttttagcacatgactgtctttcttgcaaaaacttaagctcctcaagggaaagcaaatatgttttactcatctacacaaccgtagtcactaacacagcagctggcatgttgaattactcttccccagctttcaacttcctgtccttcatactttaccacctctcccagccacccttctcagccccaaagtttctgttctcttctgccctcttagtagcttgccacagctggaccaagaccaagtccatttaatagcctaaaaaaagaaaagaatgccaaccctaaggcattc

SEQ ID NO: 2335 - DNA, 1650 bp, artificial
  synthetic oligo
agcaccattcataatgcttcacaggaatggtggtcattgtaataggagtgtacatatcttataatgcctcaattacacaattgtcaacagctgcctcaatgcaaagggcagtttgggctgaggcagcgtataagcagaacattgcacgctataatttgcattaatagcctttccacccactatgcttgtatctactctaatatcacaagcttcatcttcaaggatcttgaagtcacatctccactaccttgctgttgccattccatttttcataatgcagctcaaaatttctctcttcagacttacaaggaggagctatctgcaaatcgcttcatctgggtttaatccctgcttccttttcctaaaattttctttattattcttcttgcactcttacttgacaatcttaaaattgttcttactgtgtatccaaaggtatgtaagaatgaggcttgacacaaataaactgcagtaagatgtgaaggcagttactagggagcttctgcaaatttgtcgagtcctggcactcattttaagcaaacaaacaagtttattgagagttcaccctgcccagatacctttctatttgaagctcagtaaatgtacaactacctcacctcagcatgaactgaaaaggtacaacaagatttccaaaagaaaagtatttgacaagcagagttaaagtgaaaattagtattttctttaaaaaaataagaagattgggttcctctgtgctccaagtcctatgattgttctttgacaaatttttcacattgttatctcttttgttagatcttcaaaaaagcagactcccaaacaggatgttttaaaagtgaaaaccatgggcttgaaaaataatagaaagaacgagcaagaagaatagtgtccaaattccatccttctgttgctactgctaactgtccagaaaggggaaatggtagacagttgatgtttcagttgctgtgaagtagtgaagtaaataataatacgggaggcctctaggaagaaagactatgtgttgacaccaaatcagccagcatagagtagcctccactctgtatgtctctgcctgtacaaattccttctctctggaggctattttcccagcctaatttataaacatcatgacaaaagagttggttatttggggtcagcataacaccgggcagtggaaaagcaaatacagagaacaagatgttctacgcgtacataatagtgtcatttcttttgaggagacacaggaatcaaataacagggatttttggctcttcggattctgaaggaaaacaaaatgaccttggcatctagcaaataagctcgaattcagaggattgaagttattacccaaaataagattagattctgccctgtggggacacatttgtatttcacagtcaatttgggattaaccttttcagggctggtggagaattaattagttctttacttctctctctggactgcctcaggctctagaggtttccatgtattctaaaggagatttgtgcagggcagccagctgtgcaactgtgacttatttattcatgcttctggcatagattcctctgagtgtgagaactgtagaaggcgcccctcccaaagagcacacaagcccaacccagtgtagcaggactttgtgtgggtgaggtc

SEQ ID NO: 2336 - DNA, 1900 bp, artificial
  synthetic oligo
cccagaaccgtaactattgtggccctctcagtggccctgggactcttctttgttttcatggggactatcaagctgacccccaggctcagcaaggatgcctacagtgagatggtaagtgaagcaaacgggtgatgaggagcgcactcccatgggattgcgaggacctctccccttttttccttctcagtttctggtcccacccccttagcccctatccccacctggaccctccgttctcaacaactttgcagctcggaaggagcagctgggcaagagcgatttcttttgtgggctatgctgttctggagccactgaatgccagttgggggaggggttgcgcagcgaataccccccatcccaagtaaaccagaaggctgagacctgcgtagcacctgtcattggcaggagcccttccctccttccagcacacacccaaagtccgggcaaccagtatacaagtctgattccctccctgtgagctaagagtttagcaagcggagagtttatttattttagagcagaacaaaagggaaagaggaaaagagctgggaaaaatgggctactaaaacaagcaatttttaggggctgactggtattcctcatcccaggcagacagctgatagtattcctccagccacctgggtatgtatctggatccttgagacaaagcattcttggcccaaataaaggtcactaagctcttgtttcttccccttctctcaagggagagctagatgttttgttttattttgttttgtgtgtggggtaatctacaaaatctgcaaagtctgctttttctctcccgcaaacagtccgtaatccccaccttgccttctgtggatgaccagagccaggccctctgcaggttttcccctctgcagagttggaatcaatcacggaaggtgactggccaaaacatctcctctgcaacctgggggctgggctgctttccccagttgggcgtgatgaggacttgctcttatgctgtggagtactaggagatggcagggaatgtttccagcactttcgggtctgtcccttcttcccctgtcactttgcctcttcttttccccaccccagctgcttctcgtcgcctttgccagacttccaataatgggaaggagcacatcattgggctctcaaggtcaagagagaaaggagcttaggggaggaacagaaggggaaagagaaaagaggcaagcccttttagggctgaggcagggaggaacagcctcacacattgcgaggaattcatagctctcctgaacccactgcagagctttccagggccccttaacgtgagctgcaaatggatggagactggcaaattatattaatagatgctcagaaaatgtttgcaggcagctctggcttctgtctcagggtttaagctggagctttccatttcttcctcaccgcaggatcaccctagggttggggagggtgacaagggcttaggtctagccccagtggcaaatccttacatgcttctccttctcccttcccctcctcccagcatgtttgaccagatggaattgaaatcaggtcaaaatgagtacccgaggcagcctgcactgggagaagagggacagggtggggtagcagaagccaccaaatggcttgaagaggttgggacagagggacagggtggaggggaaatgccattatatttctgtcttggtggtagcagtttggtgttagattatgaataaatgaacatgctcttgctttacttttcatatgtacatatatttatatatttgtgtgtgtgcatcataggtatgtgtaagctttccctagccttagggacacactacctttcttcagtatactccctgccctccagaccctagtcagctgcttcagaggcccccccaagctgcaccctaagtacagtgtt

SEQ ID NO: 2337 - DNA, 1350 bp, artificial
  synthetic oligo
gtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtact

SEQ ID NO: 2338 - DNA, 1150 bp, artificial
  synthetic oligo
tgtcctgggccataaagaaaagcagacctatagcttatctgattcctctttttgtttatatgttctggaccatgaagaaagacaaacttatagcttatttgctttctccctttgccttcccctgctccagccagcctaactccttttttctaattaggattccacagttatgttgtccctgtgcctgcagcctgtgaatggacgccccaccacctccgtcacagcagtggtcagcacagataaatgcacacaacacacatcgatctggccctctgagaagagaatgttaggcttctgaaagaagagataaatagtgagagataacatctaagaatcaaaataatatattcagtaattattttctgaacctatcctaatgctctgaccgatacattctttagaacatctacccgtacattccaaggaccctttttccacggccctttttctccctgtatccctcttcctgctccccttcttttgcacagggcatgtttcacatatacaagatgttcttacgtgtcatcccactttagagatgaggaaattgagtctcagggaaggcaaacatcaactttgtcttggggaaagggcaggaagctggaagggaggaggaaatgagctctggcgaaggaaagaggacatggctgggatccttatggggtggtgtacgagtacccgtgccccccccgatctgtgggctgagggtggcggtgactagcgctgggaccagctccttctctctcgctcccaagcccacaagaattcggggagaaagggtgaggtagggggctccgggagagcggagagagtttggaaagaatccatccctccttctccccggcggctttctcgagaccctcacacagcgccccgccccgccccagtacatttcctttcagggaaagggacagggaagaggctgtcgggaaatggcggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtccc

SEQ ID NO: 2339 - DNA, 1050 bp, artificial
  synthetic oligo
ctggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggc

SEQ ID NO: 2340 - DNA, 1150 bp, artificial
  synthetic oligo
aatcaaaatcctgaagacctagactggatgaagctttgccactttctctggtgttcattgcctctttttcttcaccaacttgatccaaactctcatgacttgaaggattatatggaattactgtctgtgcatggtcagaatgcatggatgactgatccatgggcatcattggttccagtggcaaagaatgccgcccacattcaattgtgaggagtttatggcacttcttatgaaccaagagtttgcagttgatacacttatatccttggcatccaagtccccatattcagtctgtgcagatggcacagtcagcacgcctgttgaagcacttggcttgaaaagtgtgtccattggcacaataaagctttctccagtggcgtgcacctctacggtagatggatttatcttctcttggacaaggcatcccgggacgttctggtacacaagggaacacatgaatcaagagttcagagtccttgtttagctcataaagtgtaaaggcttcttctaactccaactgagatgatactgtacacgggtctccttcctcgtctatccatttcatggtgaagagctgttcgttgtcaaaagaacatgtctcgaaccacattgtaaaggccctcaaaggagacagaaggttcaaaatgtgttatcatgatatccccgcggtagtaggctttcacccagacctggtgggaatggtccccactgcagccgcctgcaaccctgtgggacatggtgctgctgtccctctgggtcggcatctcctcactcccccgcctcaacgctggaggccgggggtgcggggagggggcttcggacgccgtgggagaccccgccgcccgcgcctgtcggagaaccgcggccatccgcccacctacctgcccacctcacccgcaacgccgacccaagggtcgcctcgcccaagcagcccaaagatggcacgttaaatcagtgagctaaagaggggattatttgataattagcattaggacaatttgctagccatttggaagaaaataattccgtatggaccaaaaatttaaatataaaaggaaacataaaaattagaagaaaatacagatctccctaagcaggacacaaacctcaaaaatgtaaagaaaaaaggtggtaaattttacacatctac

SEQ ID NO: 2341 - DNA, 1050 bp, artificial
  synthetic oligo
aaaaatggcagttgtgttctagacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgc

SEQ ID NO: 2342 - DNA, 1150 bp, artificial
  synthetic oligo
ctgctttgagagtgacacatagcaccccggtgagggtcccgtgtctgagacaggacgtgcctgccgggaagctggttgtctgcaaccttgtgtgcactcacctggaggggggcggggtgggggtggcaaaccacaaaatccctaggagaggcagcaggctggggagggcacctgaagttggtctggaagtcagtcagtgcctacaggcaccaaatggaaacgtgctcataagatagatgagaagcaaaactgagggccctttctggaggtggaagacagcctgtggcggcagttccagattgacacaagagacgggctcaggctggggcggcaccatcaaggcagagcacttctcacagaatgtggcaagctcaggattgatgaccttttccaatgtttgccacggggaagcccagaaaggctgtcttttggttgcagcaggcaggtatgcattgtgattgatggctcagggctgtttttatgtttgcgttacatatggaatgggggcaccggcgctcttgccagtgctgagaacctctcagtgtcttgatcaggccctgggaggcaggcatgctcccgactccccccgcgcatcccagggaggcagaatccacgggaactgggctcgtacccaggcactgcaaccagtcaggggatgaggggcaggacagaagggctgtgcgtgagtgctttcgggagggcagtgccagcaaatggacaggagggttttgacttgggccaagacaacgccgtggagacacttggacgctgatgggcttttctgtgacagagtttgctcaggagatgggcagaaagcctctggggcgctccctgagttaggactcagctgcggcctcacggtgtcaagtgcctcagcgatggtggacaagcgcacgtaaagggaaacttggtagcgtgcagggaagtagggaggtgcatgctaattcgggaccacaggctaggaggatgcctttgtgctcaaagagactgagcaatgaggtgtcactaaagacagcattggcgaagcaggctccactgggaaaagtgcatgcggagctgtctgcagggaaatcccctttgaaatcagattgcccagccaaactgcggctggcttgggagaaagggtggtccttctgacagctcttaggaa

SEQ ID NO: 2343 - DNA, 1000 bp, artificial
  synthetic oligo
gaattagttacataaacgcaaataatataaatcaattaatagcaaactaaacccaacaatgggtaaagcagataatacagcatgacgaggttgtgtttaatcccaagcatgcaagctgagtttaacattttaagagatccataatgtaatctaacacattagctgaataaagggaggaggacaggacaaataccacaaaagatccagttaaaaaaaaaagtatgcaataaattaaccaaccgggattgaacaacaacaataccaataattctcagcagatcggtaatatagaaagctatctctttaaactgacaatgggtatcaaaacaatagaccccatcagacaccacccttaatagtaaaacattagaagtattctccttacaatcagaaaagggataaagatgactggtatgacgaattctgttcaatgtcgtactgagtctagtgcagtaagccatatgtcatactaggcagtgcggtaagctgtgatacatgcatgcctacatacataaattaatacgtgtataaaagtgaaaaagctgtcaacgtgactatcttcatatgaaactcaagagaagctacagaaaattaaaaataataatggagattaacaagtttgttggctataagacgaacatacacaaaccattgtaacaaagaaaataccatcattattgtaaatataccatttacaacagaaaacatgtcttgtgaaatatacgatgaatctgcttacttggcaactattccagcactcttaaacattcttatatgctttcctgtactgtagagactagaaagttggaacatgaaaggaaacacacatgcacatgaccccacgcatgtgcgcacacactctctttctctctctctctcgctctctctctctcacacacacacacacacacacacacacacacacaaatacactctcacacacatacaatttaccagagtcccttgcagttagggtctcaaatgggatatttatcgcatc

SEQ ID NO: 2344 - DNA, 1900 bp, artificial
  synthetic oligo
caaaagggaacctttgtacactgtcggcaggaatgtaaattagtataaccactatggagaacacttggaagttcctcaaaaaactaaaaacagagctaccgtatgatccaccaataccactcctgggtatatttctaaaagaaagaaaatcagtatattgaagagatatctgcactcctcaatatatatttgttggcttcttttatttcttggcgcacttggggttacccactctgagtacacatatcacagtttgcaaagtcatttatgagaattttatgccttcagcagggaatttttacccttcagatgtgccttaactctacctcaatactgtgaccaattaccatttgttaaattatactttatgtatactactccaaaaaagaaaattatcctgagagtcaatcttatccataaggacacaaaagaagactacgtaaaagatattcatagatgtccataagtggtataaaattacagaatttaagaggaatactgggtaaaaataatttagttaacacataaaaatttaaacatttcattttcagaaagaaccatttgagactcagagaacttaaatcacttctctaagactgccaccagtttacagaaaagtcaggactagaacccatatctcagattgtttattccacaatatatagagccatgcaacagcaatttaactaagtatacacatttgctaaagaaaaaaatgtaaatgataaaatgatacacaatggattgtaaaaccaagaggtgaagttaaatgggactttattagtcaagattctccagagggacagaaccaatgggctatatgtatacatgaaagggagtttattagggagaattggttcacataattacaagacgaagtcccacaataggctgcctgcaagctgtggaagagaaaaggcagtagtggctcagtccaagtccaaaagcctcaaaaccagggaagccaacagtgcagcctgcagtctgtgcctaaaggcctgagagccctcagcaagccactggtgcaagtccccgagtccaaagaccaaagaatctggagtctgatgtccaaggcagtaggagcggaaggaagcttccagcatgggaaaaggaagccagaagactcagcaagcaaacttatcccagcttcttttggctgctttgttctagccatgctggcaaccaattggatggtgcctgcccacattaacggtgggtcttcctctcccagtccactgactcaaatgtcagtctcctctggcaacaccctcacagacacacacagaaacaatactttaccagccacatccttcaattcaatcaagttcacacctgatattgactatcctggggcccaagatacagtatagtgtagtggaagataaacagctaactaaagtggtggggacacataaatacaggatggcgcctttatttattttgtcttattagagatgaaggtcttgctatgttgcccaggctaaactcaaactactgggctgaagcaaccctccttcctcagcctcccaagtagctgggaccacgatgcacaccaccatatccagctttaaataaaaccacacagagtcataaaatagatttatttcattacacttctcctttacagtacaaaactacatatcaacattatccatgttaatcttttaccaatgtgttttcttcacagaacacaaaaggagtatgagaaggttctaggtaatctgggggcttccaagctaaaagtgaggcatgatgggtggagaaaccagtatagatcttcaaggaaaggagagatacagagcaatggaagatgaaacttctgacagcagcatttagtgtctacttctacattcacatctcacgccattcattcctagcgcatggcaatactgaccttttt

SEQ ID NO: 2345 - DNA, 1350 bp, artificial
  synthetic oligo
ttctccagaaacccagagccaatatgtctgactcttaaaatcacagcaagggtaaaatggaggtgatagaagcacaagagcagacagggacagaataaaaaataaagactggctttaaccagttaatgattttgtaacaggagatagcactattcgagcatcttcactttctattaaattacttttgttttttggcatttttttttaggagacggggagcagcacaaaaaaaaaaagagtggcataagttgtactaatttctttctattttaaatgcccaaagatgacagtacattaaggcattacaatacacgtctcataatagctccttgtggcattggtgtataaacgttgtaagaagggacagctaactaggatcaaacccaggacttcagcagaatgggataaaccaaataaaagcgagtcttgtttcaccatgttttctctgcaaagagagaggtaaagagatgaggcttagaggtgcatggctgtggacctgacgaaatgcctggtgccctgtaagcgtcccgagtttgtccagaagagacaataggatatcccagaaatcggagggcagagttctcattcgcaagcccagccccaccctcgtgcagtaagatactatgtctagtgcttggggtagaatggagaggcccccaagcagccagaagtgccgaacatgcctccattccgtcgagtttaccctaagaccctcctctgccaagccattagacgccaagctcagagctggaaaactggaactaacaaataaataatagcagggccgggtgcgtaggccagtctgtcaagagcagtttgcatacttttaaaaataactattagctttttctggcgcccagcctaacggccacgggaggagaaggaatgaggaccaagccccagggggcccattccgggcggcctccaaactcctcatcctctaagcctccgacctgcagctactgcggacaggtccctttaagggtccgcgctccccgcctcccaaccccggggccttgtttccagggaccggcccccaggagggctcggcatcgagcgcagaaggcggccccctggaagacaaaggcgcggactcgctcgcccgggcggcggtgcagacgcgaagcgccagccccaacctcggctcctctggctcccgaaggcgcggcatcccccgcctcgcaaccctgacgccttcccatccccatggtcctctggctcctgcgaggccgcaggtcctcacctgaaagcttgaagactcgtgaaaggctgttcgcggggctgagacccagactcgctccggaccaggttagcgttcccgcgcagagccctgcagtgctaagccaccca

SEQ ID NO: 2346 - DNA, 4500 bp, artificial
  synthetic oligo
cggggcacataatcttcagccgggcgcttttcggcggcccgcggctggctctctggcttggcctgggaggctggcttgccctcactttgtggcttgtcctcaccttcagacttgccctgcttttcctggtttccctcatcttccagttgtccctcatcacctggctctccctcatcctctcgctttccctcgcattctgtcttcccctccatgtccggcttttcttcctcgtctgactttccttcatcttctgtacttccctcatcctctggctttccctcactttctaggtttctttcattctctggctttccttcattttctttgtagagcttttccatgttgagatgttcccttctttgcctttcctaggagacaaaaagaagacacaggacactgagggctttgggggttgaacacaggtccttatagtacttgtctttcttaacttagggttttcctggccctatcccatcttccaggtgcactcccacccttacattccttcctttccttttcactttacacatgttcacacaagccaaccttacagaaacttccacaggtgcttctccctacatttaaggaggatgtgctgagaaatgcgtaggagcatattggcccttaaactttgctctggccttggctatgcctacccataccaattttaactgggtagttccaatttacacggacctgcagaaatcctgggcagttttcttctttttccccttgcatgcagttgtaagacttataaaactgcagacagaacagaaccatagccagttctcagatttcagggctacccttatgtcctcagggggcatcacagatgctacacctccattctcttactttcttattctcccctctatcctcaccagccatagatcaccatatccccttagggtcttgacagcagtcatgtatcccgaaactgcaagagggaggattggaggaggggtggcaggcagtggcctccccaacttctgctctggcttaagttactcctactcccaagggtcctggtgcagtagccctctcccactgacctgcaccgatactgcaggtctttccttttcttgtctgggttagtgcccacaaccacagacttgaagacctgcagaaagacaagaaacaggtgggtgaatgagaaattgagaaagtgaatgactggtaacttggacactggttctttgggaccgtatttgtcaaaactttccgagctcctatcacctcctcgccttttcccttgcattctctgattccccctccgcgcgcagctctttcttaagagcctccattgttctacttgtgggaaataggcgagaaagattatttccaaagcgtttctatgtttctgaatcttcctcccaaatttttatctcacttttctggcacgaaaatgagtagggttagagacaaggatgttctgaagacagagtgttctgatgcactcagatctctacattccaaatccctcaccctagggtagccaaatagcagagcccaccacttctctgaaaatggtgatgacagagatagggggcagggcagaaatgtccaaaacactcctgccacctcctccctccccacatacacagaaagcccacatttttctgcaatgcaagagacaaattatttccaaacccggtaacatttttggtcttgctgctacctcatctcaatcctcctacttcagaagccactcctcctggatagggagctgatccccagatcaaacctctgtctccctttttctacagcacctccttcccctgacccccttagcccaccgtttccggctccaaaatggagggaggttggagaaaagacacagggaactcaggcctggacccgttgcagggtccgccctcagcagcctggggtcactgactgtgcccgcctcccgctgccttgcagggatcaggccgttttctcgccgtttcgtcgctgttctcttccctggtcctcctcctcctccatcagacatcacccggtcgccggcttcctaggagttcccaactggtacccaattctcaacccttgacctctctcgagttccgcccccctcccccctccccgccccgcaccaagccctccatttcttgcaccaaatgagtgagcatcgggaaaggagtggagagaatccagtcctggacccgctctggtctttgccctctgccatcccaaccacagggatccacaggctgtggatgggttcgtagccatctcggggaaatgactctttctcacatttccttctgccagaagcctgcacttctccagggaaataaaagctggtacccatacctcttgcccaacacaaaaaaatttctgcgccaaaatgaatgggggtggaacagggcggtatctagaaagcagatccgatcctctgtagcctatgtgcattaccatccctacctcaggggtccccggcttgtaccgacctgcagggctgtagggcagttgccttctctgtccttcagtctgaagtctgccttcctccacggaaacagggatctggtacctggaggagagggacttctgcacacgtcggcttcagatcacgtgagaaaaacgtcaccagtgggctcgggtccctagttcccctcccacccgcagaaagtgcgtcaggagccagcccacttcttcccttcactagtctgtccgtctgagcgccctcagcacccccaaccccggcttagctctctctctcgccccacagcacggggccctgtcactcattttggtctttgctaatcccacaggtcaaatgtggccctttctctgtgtagtatgtatttattcttccgtggttatcagggagggaccgcaccttcttctagagctattggccattggtacatctcagaggaattttttttctttctctccttttatccgaaggcacctactcgatctaattctacacgcagccactgatgttcattctgcctgtgaaccagaccttctcataatgggtacaaggtggattgtcaagtagggacacaagtagttaaaataggggttttatttttttaaatttttttgatcttatttaattcactctcctcagcatgggttattcttataagcacaaaattaaataaagctatttcatttatgagaaagtgtttaagagagagaaaaacttaaaagatttcaaaattttctactcagaagagagaccaaattaggttcataatattaacttttgccatatacacaaggaattcaattggcaacaagcaaaatatacattagaaatttttcataaatagctggttctctcacgttctatttaacacacacacacacacacacacacacacacacacacacacacacacacatttaatgttcccaaacgattactgagtgctaaatagacttgctggaatctgatggttgaaagaaaattcaaaaatgtctctttaaaaaatttggctcatggctattttcattcaaatgtttagctctaggggaagggaagagctgtgagaccaaggctgcaggagatgtgaaggatgcagaaatggtcctatcctccctgccctgccaagatcaggggaaggtgttcttctccaccccctcatattctagaatttctcatcccctgcatttctcatccccaggcacatgactctgttgctcaagagtcatctgtccaagaatataactggacaggtgaccaaggtggtgatatgagtaaatgcctttggctccttccctcctccctccccctaattcccacagggataacccagccccagcacagagtggagcattgttcatgcctctagaaaactagaacagatctcttctagacccttgcagctgagggtgttcatgaggcctgaagtgattgctggggtagagtcccctgcaacctgcctgctctctgcccttattcacagtgcctgagtggaagcctccctagaccctgtctgttacctcccgcctagcctaaaaagtgcagtctggcgggcctctcacccccaaactctgtatcttcagggaacccagagggagcctaaccttgctgcaggattgctgcctgccagtccatactaacctatgactgtctcagcaaatttaggccagtgtctaaggagttctgccatgctgtccatattgacctagaccaagtattcccaattgatgaagtctgtgggccacctgaaagggcatgtaaaattgcatatgtttaggaagtagtggagtatgcacactcttgtgagaagaagatctgtaccctaggagcctgaatagtgttttgttctatttgcacaccccattctgtttatccatcatatgttgatgaatatttaggcattttcatcttttagctgttataaataatgctgccatatacaatcacgtataagtttttgtgtggatgtatgtttttattttatataagcaagttgacatcatgaaaaagaggaaaccataaaggacagaaagaagaagctacttgacaaagagataagaagg

SEQ ID NO: 2347 - DNA, 1500 bp, artificial
  synthetic oligo
ttcctctaggcacacagtattcactaacattcaaaggtagggccaagggctcccctttattagcaacttgctccttttcatctttttcatcattttcctggttgacattttccacgatgagattgtttaacgctcgttcctctttggactccattactcctaggagacagagagaaaatggactcaattcttggtgaactgatcagcaccgaggacagaggcccgactacccacctttcaaaattcagagccctggatttcaaaggccttttttaaatttcattttttttccaccagagaggccccatgtaccctcgggggggcgaggggagccagtctgtgcccttctctcccgcaaagcccaccatcttctctgcagatccatctccaggcctctgcaggcaccaaaatggaggacgaagaaggggtgggggtgggggattgctaagtgtgggggtgaaggcacggattggggtctcagactgggctttcctcatgttctgaccccctccccaccaccgtccctcgcactgacctgggcctatccttgcagtctcctcctcccgattctcgacgtgaggtgcgtcgccgcaacacttggccccgcaaacctgcagacggccggggtgggaagagtgggggctgctgcagcggaacgctagagaggacccgccgccacccggccccttccccacgccgggcccgggccctcctagccgctctcgccccccgcctcagccgcccagccccccaagctgaccaccattttctgcatcaagaagggcggagcaggggtgttggaaaagcttgcgctggtgacggaggcaggtgcttccgaaaggtcgtagcctcaggatcgccggctcccgcggggccgggcacccctccgctcacacaaggctcgcggtcccgcggcggggccccggggctgcatcgtggaccggctgcgtctccgcgctgctgcccggggatggggcatccgcaggccggggctgctcccccacaccaaccccagggaccccctccgggtcccttacctgctccccctccgcttcctactttcggggccgtacctggcccgcacgtcctcagggacaccgggaacaggtaccactgccgagaagggagcgagcgacggcggttctgacgccacaacgaggtaagactcagtgttggccgatcacgtgtggctgttgtcatcgccagaggctccgcccccgtcccacgccccctcctgcagcccggagtcaggtggtgctttcgggcccgcccccatcctcaccgggagtcccttttaacatccccagcctgggctctgccactcttccttctctgtatattcttgagacttcccctgcttgcccaggaaggacggaaggtatcttctcagggagctgttggccattcccacttctctggggacttgcctctctctgcccttggctcccaggattcacctccttctgcctgtctacctccttctgtcctcctaccaatatt

SEQ ID NO: 2348 - DNA, 1250 bp, artificial
  synthetic oligo
cggcttctctcaccctggcatgctttctttttatccttctcctcatctttctccaattttgttaagagaaaattttaggcctggggtatgtgttggtgtgtggagaaaggctgaaatcccgggatggagacaacagaaatttagagatcatttgaaaatagttcacctcactcaatgccggcctgtggtggtggggtggggcgcgggacggggcgaaggagggagacgcgggccttgcaaggcccaggcctgagggtgaggagtggggagtggaaacggaaatcctgaaggaaaggatacagacaggaaggaggggccaggaggtagaaatccggggggcgatgacggtgatgatgagaatcccaggttcaaaataataacgtctgtcttgtctctggagctggttgatccacagatagctccttcctccccgccccttcctttttgtttggaggtcccaggatctgtgttcacagacatctgggggaagaaaaggagcaggaaactaccccgcacaggtcagtatgagagaggcacttagactgagatctctgaggataggagtcgggaaggggcaaaagctaggcgaaatttgcggcttcgcagtccatctccttttctgctccgcctctcctgcctattggagaggccattagctttgtctgctggggaaacggtgggttcctgaggtgggaggggagaaaagggggagatgagagggtggagggaactgccgcagacttatgaggtctggacctgtggggcagagatgggaaagtatcttgcctcagagagaaactgacaatcgtgattcaaaagtaatgaagcaatttgtctttacattttctccctagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgca

SEQ ID NO: 2349 - DNA, 1050 bp, artificial
  synthetic oligo
ctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaac

SEQ ID NO: 2350 - DNA, 1600 bp, artificial
  synthetic oligo
ctatatttgtattaccattgagcagcaaaaacagttggctgggttatttacccacatgcatacttgaatctacctcctgcttcccatctgaaaataaatagctcttttctattttctagtgacaaacaggatgtaggctgttagtaataatagtaaagataataactataaggaacagaacatacaaataaatattgaaaagaattggtgaaaacctctctcactctcactcccagtcttgtttcctgagccccatttcagcgtctggacagaactgccagggaactgctagactttagggtcttggcggacgggagttggagaatttagagacaggagaggaaaaaagaagacaggatcgattaactctaaaaggctgatcctccctgataatctgagaaaggcgaataaatactccaggaagatgataccctttcggattgttaggttgggctggggatgggcaacccggcttctgctgaagtgctgttgggaggattaattagggatccgagctcactgttaacacacgggcctcactggacaaagggctgaagtgaattgaagtcagtatgtagtctgagttctctttccatcctgagcaccatctccctattgccttagaggcaggcgggagcgcttcttgctgctaaacagaaaaggagaagactactgttggctgcggatctgaaaaggttcgaatgattaaaggctatctgaaggcgaaggagaagatcatagcgcatgcaagactacattgcctatacccctttccggcccctactccgatttattttaggggaaaaaaaatggtgggcttgggggagggatctgggatggggatggcggtcaggtttgggtaccgtgcccctattgtattgaaagcaagctggcttctcgcttagggaaaggagaggagaaaaatgtcctggccccccgccaagtcggtgtgagggtaggaatcacctgcaaacctctggaatggaaaacggacaccgcagcgggtcttgtactgcagttcccacagccacgccccctgcccattttgattcagaaaatggtgggcagtggggaatgctggggagatgagcagaaaccctgcatgggtattagcttcctattgcagaggatgtgggagttttgagcgaaacatagaaaaagaggtatgcaccccggatgcctgaaggtgggcatgagagtggtgggtgggggcgggtgcccttctgaaactgcattctctacactcctgccctgcctcctcattcccttttggggaaaaaaatatctcagcagcttaacacagcaaacgtttatttctagctcacaataaatgccgaacatgtgttggtgaaggtgtggggtgaaagggccctggtccccagtctctcaggacctcaggctgacagaagctctacagcctggaacatcactgatcactatggcagggggagagagtaatgggaatctctcatcccactataggttagtctagaactaacatgttactgcggttcacagctgattagctaaaactatcatatggtctcacctcatagcaaggggatagaggggacaggggattagaaagtatagttttctg

SEQ ID NO: 2351 - DNA, 1650 bp, artificial
  synthetic oligo
tctggggcttagttgcctagcccctacccaggcctaggaagcttccacctgtgcagaaacattcccagcatgaccggtgccttgacatctctaataaaaagctcttggggtcctaactgggggaggtcgtgtcctcccctgaagccctccagactgcgggctttgtgcaaacttagaggaaagtgtgccagatgcccaggttgcccatcccccttggctagtgtttgcatgcacctccttctcacccccactcagctcacctgaggaggacctgccctggcagggtccagagaagaaggaaggagagggttgcaggaacaagagttgtcattctgcggggatcttgaagccctttctcagcctggctgccaatgtgagaggggatatccctgcaggaacgccaaaagtacagagcctttctccaacctgggctgctcgcaaaagagcctgctttctctcctcttctgcctcttctcctctggcctgtctttacctgccaggggccagaactattcccctggaaatgatcctgacacagataaccctactggcttctgcttgggctcgccttgggctccggagggccttagcctgccagctgggagctggaaaagattctctctgggcagcaatcactctccaaaccctgaagagtcttggaggggagggaggagggagaccggtaggaagatgttttcctgcctcccacctccccctagatgcaccctccgaaagcagtaatttaaaggcacagtcggcagcagctggagtggggttcagagcctgcccgtgtgccagggaggagcttgggctgccatggctgtttggggagggccagaggtgttctgtccaacctctaactccccagctgcaggagggcatgtaagcagccctgctccccccgccccccacctcccactcccgaccagctttcctttcatcctggagccaagctggagcccaacagtaaagtcctaatgattgttaccagggggaaaaagacctgagagggtttaggcagcgccaccaggtattctcaagctgacagcttcaggttagagagaaggtgaagaggctgagggcaggaatagctttcccccaactctctggacagagacacagaaggtgcatgatacagaggaacttgggaaccctcctcaagtgcggtctgcctgcttgacagtctgtctgtcccttcatctgtctacctgcccccatcccacctcgcccttgtagttagttgtgcagccattcccgtgcctgctttcctccctcaggtcgtctcttggggtcctctatagctctcagaattcctcctcccagacactccttccccagcctggctcatgggaagggacagagatgcagagcaaggctgggacacagtaggctttgcaggcttcagaggaatggcagcgggtcaagagcagtgacctagtggccctcagccctggatggaggacagaggcagaggggtgggctggcctcttcccttgcctcctgcacatttgcttacagcaacaaggtgctttggcagctccattttctcctgcctgactcttcctcaaaggttccagtgtgttatctaaacacctctgagacttctcccctcccccatttcctcttgctctctcttctttttttcactct

SEQ ID NO: 2352 - DNA, 2000 bp, artificial
  synthetic oligo
ggacctgtggggaaagcccatcttgtggcgacacactggtaagggctactcaactcactgttgaatgctggcacaataattggaaatattgcactgaagaattgggcgcggctatatttatgtaaaattcaacacggatgagaaatgattgaatgtttgagtgtgtttccaatacaacccaatacttggcgttggtgctggtggtgggtgcttcgtagcgcggaaaccctctgacgcactggattcattttgcagagctaacaagttatcagctacatccatgccgactccaaatgccacagctgtcatgccactgaaacgctattcctacattcatgcccacatttatatcctatatgcaactcaaagggtccaatgtggagtcccacatctaacctttcactgctcacaacgacagctctagggctataagcccaaaggcacactagatagcaatctggcatcgtccccaggacacttcttcctcagtagactgcccagggacagataggtagataaggtttggatgacatcaagcgagctgaacacaaggaaaaaaagcttccttgggagacaagaatgctggcatctctacgacaggggcactgttagcattacggacctagaaagtgagatgtcacacatagtcccaactacctccgacccaggtcctctcacctcacccccagctcttagagctagtcggctgtggcgcatgcgcactgagccacacccgctccccacggagccctgcgcctctctgctcggctctggcagcagctcgggattactcagcaacgcccccctgcactgtcacctgcccccgactccgacctcgggagcggctcagtcccttttctcaagctacgagtggtcctggggatcaactagactttcctttctccctcttctcacaggccccccacctcccggccttccgggtcctccagcccctagcccctgttcctgcccacgcacaggcaccttacccaacacaatgggaaggaaacaggagagggccgcgggtgccaggcaggtcagctctgcgtgccgggaatccggctccttagagtcaccgtcactgctcctgctgcctcctcgtcctcaatggggcagcaagtgcggcttggacctcggtggcctgacagctgccgctcgcgcccgccgctgccgccgcgcagcgtctcgagcccgcgcccgcgcccgccaggggagggggcggggcccgcgccgcctcctcgtgcccctttctcggcggtggggacccggtgtagccgcctcccgccctccatgtggcaagcgctccctggctcgcccactcttctttcatgctcatcgtccaaccctggtctcccttgtcctccttctcctcccctagccgattagtaggcacagcggcaatagaccgtcaaatattgctcttccacttagctcctctgcagcctgggcctaagccctcaagcagggctagccactgccccacttcctgcaattatcctctgatctacctcatttatcctagctcaaaatcctttaattttgccaagagggtagtacatacaccctcttgtttcaaataactcaggaaaacacatgatcacaacacattgctaggccctctaactggctacagcttatgaaattttcaggcaattaaaaaaaatgtccacatctgtagcgcaggcatagaggacacactgccctttactcttaccagatacagttctagagggccacacagggggcattacttgaatttcccggaattgctgctggggcagaatttgatgttttaattgtgcctagccgaccagctagtctctttttgttgttttctgtagccctctggtacttccaactagtttgtgattttccccctggaattgaagaaggacaaagctcctgaggtcatttagcctgcactccacctctctgtcaggcagctccatctctgaagcttccccattgcccgaaaccctgtgaccttgtggcacaggccc

SEQ ID NO: 2353 - DNA, 1600 bp, artificial
  synthetic oligo
tcggaaaaagaatgcatgaaaaatcttcaggacgccacaggccacctgcccctcccctttactacctccccccgcaagaggtaataagaacccattaatctcatgacctcaggtctcaatcacacacccctttgtcaaagtttacccccgttatttctcagattcttacatgagctcggaaactagcgttcccctgtattttacttgcagcctctcaacaggtgcctgccttgagaaaattagcctctggggtagagtcgacttttgtccactgggggtcgcagatcccagtcctcagggcctcaagactgtgccgcgaaggaaggaaaggaagggttgggagcagcctcttctgaaaacctgatacctcccctccaccgcctcctctgtcgccaggcggaaaattccctctcccatcttctgaacacaagccaaagtgcctcctgcactcccgccccccgtacatttcctgcgggaaaccgtcggcctaccagctctgcaatcagccgcacagaattcaaattcggattcggctttgatgacctgccagagagaaagggactagaagttggatgacctcccacccccatattccttcccaggaagagatgaggagatgcaaaaggggttcaagacagcttgcgatcgtcttctcccgccccttgccacctccccgaacacccgcccccgacgcccgacaacacccccgcccacttcaatccaggcaaatcataaatcctacccagtcggcagcatccagatgagccacaactcctttctcagcgcaaccaggccatgggagtgctccatcccctgcctcgcagttactgattctccaagccgggcgccgcccagtcctggtggggcttcccccacccctctccgcgccgggaaatcgcgcgctctttctttacctgcgctccactggtgggcagcgtatgctcccgcgtcgacagctctgtttcgccttccggtccccatagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctgtgagtttgctgctaccccgtcgcttcccttctccccatccccttccgcctcggctctgctccgggctttgagaccggatgcctgaaacacgaggtgggacagaaaccaagtgaacaatgagagttccttacctttgtatagggggaaggggggaaacagcatttactgagtgctttctgtgtgcggatgcgcctgtctcctttcttctcagcagccctgtgaag

SEQ ID NO: 2354 - DNA, 1200 bp, artificial
  synthetic oligo
gcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagt

SEQ ID NO: 2355 - DNA, 1800 bp, artificial
  synthetic oligo
gtggccttctgcggtttttcaagcatttttcccacagtgcaaaacactcaactccaatacatctgtagtgcaatatgctccaaggaaaagtagggggtgtttccgtaatcgtgtttcatgtcctcagtttcctaaatggccgtttttatcagttatctttctaggttatctttgtggtgatattatcaatgtactgatgtttacccttttcactctcattctcctacaactggatggtggaattttccagaacttcattatgtgcgatatggcaagagagaaagtgaatacgctgatataagaagcaaggtaaccctgctaaaagtgttcagcatctttctccccatgaatccatgtaaataagcaaacaaggcacagttacagtgtacatatagctaaataaattttcaagaatccattcgttttccagcttccctgactctgagatcactattgcaattcattctctttttgcactgacaataatcatttcgtttctttttgaacagaaaccttccttccttccagttgtgtgtcagtagaattacagagtgtccacggaaacagctcatgccctagtgtacagtggtgcagccaatgagtgacctgaagtctatgagcaacactcattgtcccaatgtgggacgagtgaccgaagctgaacccacaacagccttcctgtgatattccacgtggtggttaaaggcatggcgatgtgattctttacctgatgtttttgtttgcagtgtttgtaatcatggtcttttagggatatgaatccaaagctaagattaatatacgttccttgaccctaacatcaagttatacagagcattgtcagccattagaagaagtcagataacgcttatttcctcaaaagattggcatattaatattcacgttaatattaatacaggctacctttcattgtgctctcttctgggtcccaagtcttggtatttttagaattttttttttttctataagtgtattgctgaatttcagagcaggtgctgacttacccattgctttccttttccattgatttccagtcgcccgagtatgtggacaagagaacatactctgggattgcaacccacaggaatttattatgttgtgccttgaagctcaatatgtggccatttttgttaaatgtttcccgtaaattttgaaacatctcataaacaacccttctccttcatatgtagaaaccagtaaaggatggcactctcagtcaaaccacgaagcaaaagctggataaatgacaaaaatcaaaattttcttgagcccgtcagaagtgggaaagaaccaccccagagggacccaacacatagccacatagattatttcaccatttaaagaggaccccttggtcaagagggaaaagggttcggggcaggatagtagccagagcttccctgagtagtgcagatgggaagaggggaaggtcacctccagagctccacttgggatccatagagaaatgatatagaaccaagaagtccactcactgggatttgttactttctgtttttccagaatattagaaaaatattatgaaaatagttgaagagaaatgttatgaaaatagttgaagctgtacttactgcacaaggagaccaagaaaaactcccacaaaatcagctgcaagtaaatccctctggatggtgccgccacatgttcctacaagtccagaacaacccttgccaaaccaaagacacttggcagaaccctgttcctttctagagacagagctgtatacctgttccaaaacaccacatctcactcagtgacttattt

SEQ ID NO: 2356 - DNA, 1150 bp, artificial
  synthetic oligo
gacaatccatccctctctatggagcctacgacagcacacacctcagcgttctagagaggacaggtttcaggccaccggaggaatttagggagtgactacaggagcgaccttatcccacactgtttgaacaagcactgtgggccaatggccatggactgagccagtggaaagtggggcttggacccctctgattggacgtttccatcatcccaacgatgcgttagttccaagtcatgaaggtgggtatttccagaaataaaacaatataacctggaaaagaacagacagaatcagatacattagaagtagttggagtaataacttcagtttctagggagcttggagaggtattgattcttgaactttatgatgtacttatgtcatcaaaaacacatacattttgtggatgggtgatactaagatatttatttattctttttatatagtttatatatatatatatgttacatatatgtattttacattatatatcttttttagttttttcttatgactgggtctcactttgtcacccgggctgcagagcaatgacgccatctcggctcagtgtagactggacaatctgggttcaagcgattctcctacctcagccccataagaagctgagactgcaggcatgtgtcactgcgcctggctaatttgtgtgtgtgtgtgtgtgtgtgtgtgtgtgtatttttgtatttttggtagagatgggtttccccatgttgccctggctgatctcgaattcctgaactcaattgattcacccgccttggactcctgaagtggtaggattacaggcactgtgccgggccctagatatttaaatgatgtccataatatgggtcctgttgtaagaaacaacctggttggttacgtctgtcgtattaatacatctgttttctaggttgacagttatactttgtcacagaagcagtaaaaccatttccttttagattgtcctttccgtaaacctcaccatcagatcacgaagcctccctaggcgtcctttttcctcctgcatccgctgaagtcaacaatcagatgtcctcaactccccttggatcttccacatcaaaccccatttccctcaactccttcctaaatttcattagtgtcagtcagctttgagcttccgggcttcaag

SEQ ID NO: 2357 - DNA, 1400 bp, artificial
  synthetic oligo
gagaaactactacaattcaactgcaagccaatccctctgggtggtgccttgagtttgtcttaaactattggaaaacaaaggatctctgcgggcatgtgcacactttccaaaacagaactctatgcatcagaggaaaaaaatatataatttctctacacatcacttaatttccgtcatgctcattgctactgcttcaaaatgccagtgtttgtccatacgacattcaaaaatgcatcagaagcgggctgcagacttgaagcccagaagctcaaagttgactgacactaatgaaatttaggaaggagttgagggaaatggggtttgatgtggaagatccaaggggaggtgaggacatctgattgttgacttcagcgggtgcaggaggaaaaaggacgcctagggaggcttcgtgatctgatggtgaggtttacggaaaggacaatctaaaaggaaatggttttactgcttctgtgacaaagtataactgtcaacctagaaaacagatgtattaatacgacagacgtaaccaaccaggttgtttcttacaacaggacccatattatggacatcatttaaatatctagggcccggcacagtgcctgtaatcctaccacttcaggagtccaaggcgggtgaatcaattgagttcaggaattcgagatcagccagggcaacatggggaaacccatctctaccaaaaatacaaaaatacacacacacacacacacacacacacacaaattagccaggcgcagtgacacatgcctgcagtctcagcttcttatggggctgaggtgggagaatcgcttgaacccagattgtccagtctacactgagccgagatggcgtcattgctctgcagcccgggtgacaaagtgagacccagtcataagaaaaaactaaaaaagatatataatgtaaaatacatatatgtaacatatatatatatatatataaactatataaaaagaataaataaatatcttagtatcacccatccacaaaatgtatgtgtttttgatgacataagtacatcataaagttcaagaatcaatacctctccaagctccctagaaactgaagttattactccaactacttctaatgtatctgattctgtctgttcttttccaggttatattgttttatttctggaaatacccaccttcatgacttggaactaacgcatcgttgggatgatggaaacgtccaatcagaggggtccaagccccactttccactggctcagtccatggccattggccacagtgcttgttcaaacagtgtgggataaggtcgctcctgtagtcactccctaaattcctccggtggcctgaaacctgtcctctctagaacgctgaggtgtgtgctgtcgtaggctccatagagagggatggatt

SEQ ID NO: 2358 - DNA, 2500 bp, artificial
  synthetic oligo
aatctacatttataacaagctctccaaaatgattctgaggcagctcaccttgtactcacactttggttaatagcatgagttctggattcagagactcagttcaaattttggcttcaccttgtattttcagacaaatcattttacctctctgagcctggcctctttggggtcacaaagggctgtcgaaattatgttgcttttataaaacaggcagcttgttgtgtaaaaagaaaaaaaaagaagaaaagaaaaaaagattaataaaaaaaatgaaagaaagaaaagtaccaagaagagtttcctcttctgtacaatgggcaccataaaggttgccctcatcttccctcagccctctccccactacctcctcaccccctccctcagcactattatcacattgagactgctgttgagatggtttgagactacctgtgcaaaaatactctccaggcagcgctgcagggcaacgaattagcatctagagagcaacagacggtgctaggttggatgctgtaacttatttgctgcaggatacaggccaaaactagtaacctgtctctctctggctcagtttcttcatctgtgaaatggagataatggttcttgctcaccaattctatgcaatcccaagttggtcctcccatctggctttggtttttctccactatcccttaatctgacagaatagaggagtgctggcaaggggcagcctttgaagtcagacatggtgacttgggtgtgagctcttaactctgcacttcctaactgtactgcctgggtgcttcagtcctttcctgttaaatgggcacactactacctccttcacacggctgctgagaagaggaaaggagatgtccatgcaggcgcctctgcacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccc

SEQ ID NO: 2359 - DNA, 1100 bp, artificial
  synthetic oligo
cgacctcccgggctcaagtgatcctcccacctcagcctcccaagtagctgggaccacaggcaagtgccaccacaccctgctaatttttatattttttgtagagatggggtttccccatgttgcccagacaggtgttgaacttctgggctcaagcgatccacccgcctcggcctcccaaagtgctgacattataggcgtgagccactacgcccatttgaaaattgttttgtcattataaaacgtttgggggagacagcccccgattttcagaaatcactgcgagacaatggaaaaacatggccagtatcttgttgggtggagtattttatgaatggataaagcagtccttcacttcaggcagttggttttaaatggcccatatgcttgaaccttccccaagcccaaggcaatactgagtcactgctatttccgatagcgtttctcacctttttctctcctccctgtgccaggacatgcctcagcactttatggtttcttgatagttcttttgtgacccaggaagataccaggtgaagtaagaaagtgctcaagaactccatcttggcagctgccaagagttgccactgagctaggaggaagacacatttaccttgcagtctttctttgtgtgccaagcccagctgccaccctggtggtctatttgaggggctcttctgagcactacagaaaggtggtagtaagcagcccagggtttggaggagaaaagcaagcatttctggcctctcacagctttggtcttgcttttgccaggcctgcatgcctcctttcggcatggctgggatgcttgagaagtcatttagctttgactggcaagggcttgctatttctcgatttaactagatttaaatagagtctaaccggggcagttgcatttcttcactttctagagctatatttttctctcgtgggttaaaaaaaaatgcacacgaaaaagccccaacttcattatgcttcggtcacagcagggaatttatagcaagagcccagctgtttgcagctcatgccagagttttttgatcctaatgtaattgagctcacatttttgaatcggaaaataatattcagaggagccgactcct

SEQ ID NO: 2360 - DNA, 1800 bp, artificial
  synthetic oligo
gtgaagggtcccgtggcttgatcaaatggtctcatccatggacagccctgctggtcagctaaggcccagggtccgggggctagtgccatgctaaaggccagactggaggtgccagggatccaaccagaaaggaaagacttgaccaggtggtgtccttccaccaaggggccaccccgtgttgctgcctgccgtacccagctggttggaagcacctggcagttggcattgaggaccactaacagtaaagtaggtgcggagggggttggcgggaggtggtagtgaaggttgcacagggccagccggctagcgtagggaagtttgcatgagctccgtaggcaaggagaaatggaaaattggctggctatctcccttcaaaagaattggctgttaaaaaaaaaaaaaaagaaaaaaggaaaaacagaagcagaaacggcaggacatcttctgttttaaaaatacagaccattttccccctcccatgtatataaacaacgaaaaccaggagggtagcttggtattggttcccgcccgaaggtcctttcctttcacacccgacctctctagatccccgacttaaccccgattgaagaagaaattttccaggatgggggtggggttttgctggatttgtcgaaagagatggtccacaggggaagagtgcataaacttggcgagaggcgagagagggagaataaccttaatcatgcacaggctccggccttaacagttgagtgggtggtggaccgaggccaagcggccaaataagtggagtagaaaggcgcgagtctgcgctgcgtgccacgtaccaaacgctcaattctccctcctgggccctgtatccatctctcgttcgctctctgtggctaatgcagagcgatggaacagcctcgggagaatagctggagaaagctcagagaaagacaaattaaaaggagctcagcgcagcagcaaatgctggagaacagcgctcagctgacccgttaaatgagtaattcggtaaaggtgtgttaatcagtgcggcgccccgagagcccagcgaaacactctgggaagatacctggcgtggcaacgggactcttcaacgctgcgatctagaaacgctgctagtcctgggtcgtagtccctctcccctgtctcgcttaaagagaggggttcctgggttgcaatacgttggagagcaggtgatcagatgcatggttggcgagcccctggcgcatggcagaatgattgaggccagggtcctagctgcaagcccatccctgcgtcccagtacattacctgcctgccccatgactggcggggctggagaaccctgagacttaaggatcttataggtggcaggggtggaaaagaagagttctctccggtcctggaaagctctaattgtcagaaaaactaggtggtttgcgtctttaaaagcaagttccagtctgcggggaaccaagcaggtgaactcctgactgaactagatacctgttcagcggctagaactggagactgggagagctggaaaacttttagtggctttccatacctgcactcagttgagcgctcgccccaatcctgtacgccggcctactctggtaaggacgctagacggcgctgccgggacacgctttccttctccggagaaaggtaagagagcgctttttttttttttttaaaccaggggatgggggacttggggttggcagcctttctcaatctgcctcccctccccgcgctcccaaatctaaaggggtgtggaagaggaggaggagcagaagcagctcttttcgtgacgcgccagagcgcttctct

SEQ ID NO: 2361 - DNA, 2800 bp, artificial
  synthetic oligo
ttggttttctctgcaaccgttaacagagaattttctttatttagcgagacccggttcctcacacaggctgtggccattacacagctcactgagacttgaaagttaaggaatgtaaagaggtcaaactctggcattgaaacagacaggaaataaacaaaatctaccaatatgtaaagatattacagaaattagaagaatgagtcagaaatggagagctctaggtcagtgggaagaattattcgtataaatcttcttagaagaggtaggtaattattaatcaaaaaataaagaaagaaacaggaaacaagtccccccacatcgctttccgaccccggagttagggtgcgcagaatgccgtctgggagctccagagaaagtaagcagtgtcgggacatttactaaagtgctctctgcagagcatgagtttagaatgcggttagtttatgcaccgactccccttcccaggaatgtttcaaggggctctttctcaaagctgaatcacgtttgtgagattcttttaagccatatgtcagtcccccagcgctttaaaggaaaacggaagcaaacaacttgggcacttggaaaagttttgcaatgaatgagcgaatgaatgaaacccggccggaacgctggaggctggaagggatgcaggaattttctccgcgcgctgcgaatacggcatatgcaaaacttaggacccagggcaggccgggctttggagacgagtcagtcttactcaaccctgcgcacctgagaacaggtgctgttctgagtgaacgactgggacctggcacgaactagcctggggccagaggagataaggcctgccgggagaagagttcccagcggctctgtccattctgctcttgccctcggctaatggctttgaaggccaagctgtgacagccccggggcgtactcggtgccttcctctgttcaaataggtgctcgcctaggactgattcccaacccatggcaagtcatttccttctgtaactcggtaggtctttgcaagaaatggagcgataaaatcagagggacagaaagagaaaacagccaactagaaaagtcagaagtgtttcttgggaagtctagggcgcgggttgtttggactgtggcagggctgtggggcccagactgggagcggcgcggagcgagaccggttttccggggctggcagctgcctggaaaaagtttcctgtggaacactcgccagcgggggcgggggcaggggcggctggcgcagcagtggacgtgggagggggcaggagggccgggggaggccgcgaagggcctgctcgcaaaccgttatagtccttcagcacctccctcggccggtggccctcctagcctgcctccccgccgggcggctgcccacctggcgacgtgacgctgcaccaatccctttcgagctgctcccgggtcccctctccttgcaccgcccccctccccaccctgaaagaggcgcaccctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcac

SEQ ID NO: 2362 - DNA, 1550 bp, artificial
  synthetic oligo
cgggcgcctgtagtcccagctactcaggaggctgaggcaggagaatggcgtggacccgggaggcggagctcgcagtgagccgagatcgcctcactgcactcaagcctgggcgacagagcgagactccgtctcaaaaaaaaaaaaagaaagaaagaaatttatattgtattcaatatgcaatgaaaagtgacataatcatagctaggttttagaaagtataatctggctgtaatatgaaggatgatttggaatagggaagagactaaaatcaattagaaggctatttacaataatctaaaaaaaattaatatcacttctcttttctagtagtagacaattgagatcagactgtgctttcaattaaagcttatattgctgataatctagatatgtgaaagtaaaaacaaagagaggacccacagatcttttcttgataccgttaatagggttaactcttaatttaacttgtcgcattcatgtttttatcttccccagcaaatttgtaggactttgtagacagcagaagctctaagaatgtttattctaatgaatagagcagatgaattttattttaaatcactgaaactccaaaatagaaaattataatacctctatgcccaatgatagttactgcttacaattttatgttagaaatcccagagggttaaggttgataaaaatgttttgttccttaatttgtatacttaatgtaaagattaagtgggattcgtctagcacatttttccctagcaatactgtttcattgaaagtcttctattctttacttattcactgctacctattacaacttgcaatgagtgacaagggtaagattctgttgcaaactggacaatagcaggcagtataaatctactctttagtagactactcttaagcaattgattattgcctctgtcttagaacttggaaacctctgcctaaaatgccatacatggggcatattgaaagcactgacacatgttagcctgcttactggaatgtgtgtactgaagagtttttattctgttttaaatctaaccaatagaaggccctaaaaccaggagggagctatgccctaaacaccgtatagaggccaaacatatgctctcatcaggtctctaaatacctccatcatcacctaagaaaactaagacatttaatgaactagtgggatcattgaagataaacttaatgagcctcttcttcaaacaaacaagagcttcagggtttcaatttctgccctctttttccccctctcgaaaatcaaacattgctgagccacttccttgcctctgataaaagactttctgtggctctagagttggcagcatccagaatgttcaacagtcacagatttctgtgtctgaactagtttactatgaagaagataaaatattttgatgttaactgcacccaaagctacacagagacagcttagaaaaaatgtacctccccccaccccccagctaattggaagattgtcagctaagggagatgtgattttatagatgccagggtgtgctctgattcaatgcatctgggcttttttt

SEQ ID NO: 2363 - DNA, 1000 bp, artificial
  synthetic oligo
atatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggt

SEQ ID NO: 2364 - DNA, 1100 bp, artificial
  synthetic oligo
aagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcct

SEQ ID NO: 2365 - DNA, 1150 bp, artificial
  synthetic oligo
ctgctctccagcctagctacatttcctgtccatccagtttttcttctgcaaatatccccccatcctcagccccacccagacaggtgaggagggggaggaggctggctcctggcagcactgtcccaagcacacgcctgaactccctcatgaggaatagctgtactggtggcaaccgcagcaagcacttggcatctgacaggctctgtcagcatcaatttaaattggtattttgcttcctaactccaggagggcaaacatgcctaagatgccagcaggggggacagcaggaaggcattcaaggaagccatgggcgattccctggagtctgtcaactcagtttccactccaaggccttccagagccacaggccttccctctgtggggctccctctgcacaatggaggtgggcaaggagaaggcagcaccttggaagctctctagagaaagacaaaaaataaaaataaaaaagaagcaacaaaagaagaggaagaaagaaaaaaggaagctccagaacagggtcagaattgaggtggattgcccccacaaagtcctcttagtactggaccccatgccctctggagtagcattcctcttctcaggcctgcttcagctgtgcttcgttgcagatgcaacctagacccaaggggcttgttaaaaaaaatagagtcctgggctctagggtggggcccaggaatcagcctttctacagctccccaggtagaaagaattcccagatccccaggattctgatgcagctgggtcaaggcccataggtggggaaatgttgcactcaagctctcccacctcaccccacggcatcccaggaaaacgtccctggtcagtatttcattcctttaccgctctaccctcctgtgagaggtgacaggcaatctgatagatttattcaggcgagtgcattaatgggtgctaatgacttaatgtgctgtccattccagataacatgtgcaatttaccgggaccttctggagattgggctttaacccaaaggagaatttccggcaaacacagctggagggcaggtgaatttgagtaaggggaaggctggtatcacaccaagtatgtggctgcatgcaccttctatgatctaggggtgtggctggctctgctgtaattcctgtggggggaaatg

SEQ ID NO: 2366 - DNA, 2600 bp, artificial
  synthetic oligo
caaagctgaaagaaatacgagttctaaaagtgctctttttaaaattatcaaactaagaaggggcaggaaatgttgtgttatttcatcattttgaccagaaggaaggcataagatatctttctcatttcacaaatgccattgccaaggcatgaagattggggtagctcccatacagaggccatggagcttaatgtcccaacaaagctgccttccactcatcctttaaaaaggaatgggtggtgtgagtccttactccagtagcaggaaggagtcagaatcagccccatgggacgaggattctctccacgttgtctctgcaagccctgtctctccccatgtcccctaacagtggctccagaagttctgccatggaaggggtgtctgagaacactggttgcctgctcctttaggactgctgcaccgtcaccccctagacacttctagcataacccagacctcgaagactcagtgactgtctcctggaatgccacctggactgagacttcttccttttcttttttctgtctcccatagcgtctggcacatagtaggtccataataaatatgggattaatgaattgtctgaggtaaagagggatggccactccctggctctaggcactgcagtcaggatcctgcctgccagggccccatctccacaggcaaactgacttagagttgccgtttgttcccaatccagtcagaaaaaaatggggaaagtggaggtagggacacaggtattcaaatgctgctttgcaatagcacaaggtagcttttgagacaggtagcccggaatttgagatcctttggggtttaaatcagtcccaccacatattattagtgcttgtactgggggctctttgctttgctcctctgagcctcaattttattttccgtacaatggagaggatgctggaatgagaaaataatggatgtaaagcacagtgcctggcacttagtaagtaagcaagtggcagctggattgtctgcatatctatgtcctcccagcctatcccttcccaggtcccccgagtgggctggtccccggtggcgaggggaggggtcctcctgggggcgccgactgtcccgggcggcggccggattgcgggtgggtgagaggcagcagacgccgtgtttacagctctctcgctagttcgccacctcagccgcggctctagggctgagccagtcgcctccttctttaagattctggtcacagcaggggctgggtttctaaggcaggtttctaaggtgtcttcctacagacaccgctgctgctaccttgctaccttcagcgctgggcacagccaggggcagcgcgagagggaggcaacgagagggttcccgggccgggcagcagcccagccccggcccggaggggggcccgacggtaagtactgcgctctgagcagccgggttggggggcacctgaccattgaggcaggggtctgtggggttagggggtcggcagtcgagcgctagggtccttaccggcccctcaaagtgacttgagggcggcgctggcatgggcccccctccacctggtctttggagtgagttggcgcgtcggaagcagacatccatctccgtccctcaccccgagatcccaaggattcgtttgggttgcctggcagccctccggtcctttcgaggccacgaaagaggaaattggaaggcaagatacgcggggatgaagttttggacgctgttggaaaagtggcggcgcgagcgggaagttttccgctgcggggtgcgggggatcggggagataaggggcgaggggaatcagaagctgggagggaaaccacccgagtggagcaggggcggaggcggcccctctgagtgctaggaccccactctccccgccgttacgcttcggaagtgtccgggacttctagctgcctctcccacccctgcccctcagcgcctctgcttccatggggccgggataccctagctggcctgccctccggtagggcgggttggagcctcagcgttcgcgaagctccgcggggtggagaagcaagaccacccttcgaggtggtgcaccaatcacagaaatgttagcaatcgggaatatgcaggagcatacctatcactttcctttcttaagctctgtaaaactcaggggagaggggcctgagatcctaaaggcgagtttatcctaactcagtcccttctcagagaacacccagatcttccttctgttcctccatccccagtcactcattttacttagagtactgatgatcctagtagctactattataactatgtgcccgacattgtgctaagctctttacctagtccatgtacagtaagagcagtagctggcattcactcagtgctttctgtgtgccaggcacagttctaagtgcttaatatgcattgccttgtttaatcttcacaacatccttatagggtagatactatccccattttacggatgaggaaattgaagcacagagaggtccacaagcccaaggtcccacagccagtgagatgcagacctgggatctcaaaacagttttacttcagccctctcactgttaactactagaaatatgatgagaatttggctttaatgaaatagtaaaatc

SEQ ID NO: 2367 - DNA, 1300 bp, artificial
  synthetic oligo
acctgtcacttctcctgtgtcccccagagtgctggactgtctgagtaggcacttgataaatacttgttgattaattaatatgagtcaaaagagtaaagcaaagcacttgtgtcacaaaacgctgtttgcttattgattcctctggctccaggagtgcccattttcttcagaagtggtagtacctcaaggcccagtggaaactgagatgtcctctgcttcaaaaaaggaaaaaagggcaaaggggaggctgcagtggcagggatcaagggggagcactgagcgtaggacagtatcccaagtgcttctgcagcacacctgtgtctgtcttccttgccggagttccttctccccacgccacagtctgcagagccttccctggctgatgcccatgtcggaaatgagctggtgccatcccaagaagtccttttagcgccaacaagtccgggtggcaggaagcaaagggctcattttccaaatagccctaggggtgaggcaagacggcagctgcaggaagatgttctctggcttccttcaaggacgagctcctgcctgccaccaggagccaaaatgaaagaggcgccagcctgtggccaccctcagagggtccctgtcctaggagtgtgcctgtccaggacactaatcagccacattccagcttcggagtgactttctattgaaaagtgaccatttatcttagtggtgtgagagggaaggagcaagtttctgaatttgccttccagagacttgacctcatcctagcatccccttccacctcccgaaggggtgacagacagactccaagccagtgtgaggtgtagccagagagatctcatatgatagagacaacttcagagttctttgctggactatgaatttctcttttatacaattattctaaatcttttccccttcccctataaatagtcctaaagcttctctctattactgaaactgtgtcctgataaataacctaaatggtttgaagcatttgctactgatgaatttgatattcttagctaataaagaattgcattgctctcggctaggcgcggtggctcacgcctgtaatcccagcactttgggaggccgaggcgggtggatcgcctgaggtcgggagttcaagaccagcctggccaacacggtgaaaccatgtcactactaaaaatataaaaattagccaggcagggcagcacacgcctgtaatcccagctactctcctggagcctgaggcaggagaatcgcttgaacctgggaggtggaggttgcagtgagccgagatcgtgccactgcactccagctg

SEQ ID NO: 2368 - DNA, 1150 bp, artificial
  synthetic oligo
gagtttggttctggtccccatgtattattgatctgctctttcctctgtctctgccctcctacacctttggctctctgtctccatcaccttttctctctcctttttcacacccttcctctggcttcctacttccttctaaatgagccggtctccttgtcctttccctgcttgttcacagaaaatgatgaagaaggaagctctcctcctcatccctaatgtcctgaaggttttcttagaaaatgggcagatcaagtcattcacatttgatggtcggaccactgttaaggtacatacagtctcctccccctggtcagcattgccctctccagagtacatgcagttgtgtgtcctgtgttcctctgagtctgcacatagctgcttgccactggagtaaggtggcctttaagctctggatgcttgttagcacaaggctgcaaaaatgcacagtcccagatgagagtggtggtagaagtttgcatgcccaactgtgtgctagtaattgttaaaccgtgtgtgtgcacttatacttgtgaactgctctgtgtttgcgttacatggggtccttcaggacttttaagaactaaagaatatgaagatcattaagccatttataaagcaaaagtgatttatattgataccataacacctacacaagtttatgcacagaaataaacacagtctcttgggagattagcttagttatggcttgctttttaaataacaacctgatctcaagcactgaaccaagatttgaaatgtccagccacagcctctttggctgttcttttcacaggaagagcaattactgagctgtgattcttcacagctcagccaggtgtcagaaagtcctagtgactttcctctaatccttaggaatagaagtgatgatatgattcacccccagattcaactctgctctgggacagaaatatccattcctgcatcttctggactctctccagaaagagaatgccatccccagaatgagtattttaatgcaactaatgccgcccaaactgctgggcagctacggtgtctacccagaaaacctaggttggtccacaggtaccctgtggttcccatactgggaccaaggcaatcctataagtaaagaaactcttggaccaacaaacgtttgctaagaggagtt

SEQ ID NO: 2369 - DNA, 2750 bp, artificial
  synthetic oligo
cattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaactt

SEQ ID NO: 2370 - DNA, 1700 bp, artificial
  synthetic oligo
tctccctcccctttcattccttttataacccttgttccaactcttgttccctttaaccagcccatcagctcacaccgactagttctcttagcaaactcttcagaaaggccagcgattaaatgatctcaagagtctcccgagtctgtaaaatgtaaataacagcccctgccctggcggccttcacaggctttccagaggatcaaataagatagagtctgtgaaagtgctttagaaattgtcaagtgctatgcaaatgcgagggattattattaatgatgggtggggaggcagccacatgatgtgagaagcagagtgccaacctgtctgctttgcttaccatcttaattgggtaaaggcattggcattgccagcctatagccagcttgtagtagggacagttatttgcttagcatcctcccctactggaccccgtctgctagcagagggcagagccagagggaagaggagaaaaggacaggacaggtcaggtgcggtggctcatgcctgtgatcccagcattttgggaggccgaagcggttgtatcacctgatgtcaggagttcaagaccagcctggccaacatggtgaaaccctgtctctactaaaaatacacacacacacacacacacacacacacacacacacacacacacacaaattagccgggcgtagtggtaggcacctgtaatcccagctactcaggagctgaggcaggagattgattgaacctgggaggcagatgttgcagtaagctgagatcacaccattgcactccagcctgggtgacagagcgagactctgtctcaaaaaaagaaaagaaaagaaaagtaaaagacaggaggacaggaggtggttaattctgatatggagagagaaaggcctagagtagtgattttttttttttagaaacagggtcttgccaagttgctcaaactgatcttgaacttctggcttcaagtgaccctcccactttggcctcccaaagcactgggattacaggcatgagccaccatgcttggcagatttaaaatagaatatcacatagaaaatccaatttataaaacagacaaaagcagagctactcagggtgaagttggggtgatgggcatggggtcccactggctgaatcctccacttgtccttgagatcactccagtggcacacactgtaattgggagtgttgagcaggagcccttgcttaacacctggtgctcccaagcatctccagggggcagccacagcctcgacgctggaggagttggggtgcagggcacagaaaaggagggagagaatgctatacaaaggcagacagagttacctactcagcagcttcatcgagtctccccacaacaggcctacatcctccggttaccctagaatggggttgcagctttagcaatcggtactggaaggcctattaaaaatgtggatccaaggggggcatggtggcatgtgcctgtagtcccagctatttgggaggctgaggcaggaggattgcttgagcccaggagttcgatgttattgtatgctatgactgcacctgtgaatagccactgtactccagcctgggcaacatagcaacataataataaaaatgtggattcagaaacgggttaaacaaagctgtgggccaagtggatgtgagcaatactcctgctttctcgcttagttttttttttttttttggtggtgtggcggagt

SEQ ID NO: 2371 - DNA, 1100 bp, artificial
  synthetic oligo
cccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctccctccctccccggtttgcaggctctcaggctctcgggctcccctgggctgtgacggctgagcggtggcaggagctgagagcgagtgagctagttagcggtctgcacgcccgggagtcagcactgggatatgacagcatgtaaattaccctagaggggacggcggagaacggtcctccgccacttctccggctggcgggcgggggccccgagcggctggatcctgtccctccacccctcgccccaccccgcccgcacccttgtgcc

SEQ ID NO: 2372 - DNA, 3000 bp, artificial
  synthetic oligo
gcacattatccgatatatggtttgcaaatattttctatcattttgtaggttgctttttcactctgttgattgtgtcctttcctgtgcagatgtttgaaagttttatggtcccatttacctatttttgcttttgttgcctgtgctttaagtgtgactcactaacttttacttctcttaggggccagactttcatcaggagagcctggttgtgacttttgtcttggtttccacctcagtgctctctagcacattgtttaacaggagtgttgactgattactattggttccctgaagggatataccaagagatacctcaatttttctggacttgttcctatgcacaatgatgggaggcgtgtgtgtgtgtgtgctggggtgagtcttcccattttctcatttctttccccttcttctccctttttgccccaagttagaaacagagtctcttatggggcttcctgctctttccctctcccatccaccttttgagtcgggtggtggtctctgagccaatgacaggtcagcaaacaggctgattccagaccaatgggaggatgctggattccaaatggaccaattagcttattagggacctggaatagctggatagctagcatctgcctcattgtccatgtggtaacgaccctcttgttttactggtcaacaatttgaaggtacaagaaaaatcctacttttttttttcttttgatggttttaatccacctccacaacttctgcccgaggccaataaaacacagccattctttttttgtaaaaagaaagagaggttcggtttccttcaattgtctgcccttttctatctcctccactatttttgttttactctgtagttaactttgcatagagcagcttcatagggaggatctctgcggtggacccggctctctcttcttattacccgttgcaaaggcctctttcttgttctaacctgggggtttgtggggttgggggacagggggattggggagtgggagaagagtttagccatagccttccttctgcatttcacacacatttagctatctctgtcgctctgtcacacacacacacacgcacatacacaccatacacacacacacgcacacccgtccgggtccctctcggtgtgtcttccttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactc

SEQ ID NO: 2373 - DNA, 1300 bp, artificial
  synthetic oligo
ccgcctccccgcccccctactgtccaatcttcccactcatcccctttcccccactccacccaatccccctcccacctctcccctctccccctgaagattgatttcccattgagatatatttctgttctattttacatttctgaatttactgaggcttttgcagccagattcgcctcccacagaggaagcaattttccctccatgaaaaattcacagctttacaccacgggcagtcccagttccctggcctgcgatatactggaggtcttctctgctgatggagttcggagtctctcctgtctcttgggggctcttgagggtctattccctgggcctccacatctgaccacaggctagcatcagaggccccccagttgaaaggcatctgagttggaacccgttctgtgacctttgctggtgaagggggtatattgggtatggctgagaaggcggacaaagggcatgggtatgagtatgtgaatgaggtagggagctggacaggaagaggctccagtgagactgtggacccaagcccagagaagacagacatggctgtttgtactgacctgagatctttctccctctgccccgcaaaggtgtaatttgcctgctacaatagctccgaggggctgcctgaagcctcctcccagcccctgcaagacctctgcgggggcaggccctgcctctgcatacctctcctctccttttcctccagcagcaccagcagcagccaccgcctccttttcctgctcacctgctccttctgtccaatcccctccggcagtggccaggcctggaaacactgtagcctggccctgtccctggggaggtgccagctcctggagagaagtaggcagagctgaaacacattctggggacagggcagggggtccggacaggttggggcagggcagaggcattggacagggaccattcgggggatcttacggcatggaagagcttccatctcagcatgtcccgctctctctgcacctccgcaaggctggtctcggttagctgcaactggaaggtcgcctcattgcattccatctcctgctgttccttgagttccgtcaggtttgaggccaagaccagcgcagctgatctgtgcagtttggcaaagccttgcagccactgcaccctgcggttttgtaactgcccctgcctgtgggcaaagcgcacacccaaggccaggctgccccaggtgcaggcctctttgacctcgctgggcacctcgctgtcctccaggatggccctgagcttgtcttccacctcctcccaggataaggatatattctcg

SEQ ID NO: 2374 - DNA, 1350 bp, artificial
  synthetic oligo
ggggagggcatccttggaggcagacataagctgcatttgataactgggagagactttggtttgatgaggtggtttattttgaatgcaagaaaatatatgagtgcagtggaaagcttgaagtgaacttggcttaaaatgaaccttgggaagatagagcatgagggaagagtgcttccttttccttggtggaaatatctgttttgctgctattttgatgttggaagactgtgctgacagaatttcagaaaatcacttggtgggatggggaaataggtgaaagagcagatgccagagtcacaatcacaggccaactgagggaaaggactaaaggaagaatggagctagtaatgcttaaatcttctgttttacaaaagatcaaaaaacccccaaacactgcaggtgttcctcagtcctgaaatataaaggtattgcggctattttcactattatctttcctgaaatataaagatattcaggctattttcactattatctttctcatttcaaaacgtgtacttgggcaaaacctgaaagctcaataaagacatgccctatgtctatgctgttcactaatggtaatttgttcattggtggtaatttgttatatgctataaatagcatataatatgtaagtatagaattctgaaacagaatatatttaagcattactataaacagcatataacaataatttgctgaagcatttagcatattgcctggcaaatggtatggacttaatgaacatggtgctactaagattagacccagatattagtgtaaatcctatgtttagggcatgtgaaagcatgaagagcctagatatcctgtgagtacatttggaatagggatttagggataggattttttgtcatcaacttgactcaacctctgtattagcttcctattgctgctataacaaattatcacaaacctgggcttaaaaccagacaaaagaaatttatttattatcttactattctttaggtcacaagtctgaaatggatgtcgctgggctaaagtcaagctattggcagaatggcatttctttttggaggccctagggggaaatccattcctttgtattttctagcttctagggcctgcctgtatcccttgacttgtggcctcttcctccattttcaaagccagcaccatcagggtaagtctttgtcacctaacaccattctgacacactgtcttcagcttacctcctccacttataagcacccttgtgattacattgggaccatccagatgatccaggataatctcctcaactcaagtttatctgattagcaaccttaattccatctgcaaccttaattgccccctgccaataacatgatatat

SEQ ID NO: 2375 - DNA, 1300 bp, artificial
  synthetic oligo
ttaaagtaggcagtccatttgtgtaggtggtaggtaaggatgtgaagaaatttaaaaaaaaaatgttttcatgtagtggctttatattttaaaaagtttttatgcacaagaaattccaatgcaaatatatgggatcataaataatttccccagcactgcctggactctactcccttcatctcccactccaaatgcaagtgagcatcagtaactttattataaaatagtgttcaccaacattttagggagctttttgtttgtttctttgtttcacactataagacttttcagaacctttgatatgttaatacgcactgtgaatctcaatatgaagaaagaacctataaatattatttctaatcatatatggtctcagaacccattttttccctaaaaagtctccagtacatgtattgtatatatgagataccctttaggaaaagttggcttacagcaaggaaattagaggaaattttaagctatagaagctggccagatgtttgccagagttttttcatctttctgggcacatagattatattcgccagcttcacttgacgttagatgcagccacatgactcagttctggacaatgaaatacgggtaggattcttgtatgccacttccaggtatgatccataaaaactattcatgtaatcttccacatactctcttttttcttatctgccctcagatgtaaaggattccatggaagattatgatgccttaggcctggattggcaaactatggccccctgggccaaatcttgatgctacctatttttgtaaataaaattttattggaacacagttatacctgttcctttaagtattgtctatggctgtttttgtgctcaacaacagagataagtagttgtgacagaggcagacgcacaaagccaaagtatttactacttggccctttacagaaaagtttgctgactcctgccttaggccatggcagaaagttcatggaaagagcttgggtttctgaatgactgcatgggacacagtcacctatttcctccatggacccacattggatctttattatattaaactcccaatattttggattttaaaaaattactgcaattggcctaacatattgttaaaggatgtgttaggtattatgtttgcccgtttgatctcaatgctccaccttttttcaccctgttttatgtccagggagaatgcccacacttttgtgaatagtcacttcgttaaattcctttatttttatttttgagacaggacctcgctctgttgcccacactggagtgcagtggcgcaatcatag

SEQ ID NO: 2376 - DNA, 1050 bp, artificial
  synthetic oligo
gttcaaagacattaaaaccaagtagtgaaaacctttagataaatattacactacttcaaagttgcacattaaatgcgaagcaaatttcattttaacagagtttacacacaacaggtacatctacaatcacatgtacacaggtacacaaagtgtgcatacacacgaatatgtacacacacacactagtgctcacacacatacaaacacacccaactgtgatatgatgaggtttgccaatgatggtacagcaagccaagatttgtgtgccaccacggaacaaagctctaagcaagcttcaagacctttgtacctattctctgtggtcaccaccttgctagtgtcacgttctcaaaggtccaggtacctaaaatcttaattcagtttacatcagaggcaagcaaaaatagaacgggggggagcttgctctgatttttttttttaatttggtacatcttatattggctcaatatccagaaggaaacaaggccttataagaggttctttttggcttaagtttttgtcagaatattgattgataagtaaacactaatttcttgaatatgggaaattgatctctttatagtagccatgggcataagaggaagagtgtgcattggggaaaatggagaaagaataagaaaaagtagaatagaggttgaaagtggggagaggcccagagaagcagggaggggccttgggaagagacttttgaagagctttgtttcttttaggaggtaaatgtaggtttcacaataaatgaaaaataataggtttggaaatactcaatcgattttcaggcagaacatcacagtgttgtatgtgaacaaatagctgtttctcagttctgcctttaaaatgttggaaatgctcaatcaagatattagtttcattgacatataacatgagcagaatgttgcagttttgctaatgagcaaaacttgaaataatctgccctttagtcctgcctttaaaatactggtaatgccccatcaagatatcagttcagttgacatttaattcattgatcaagaaatgttttgtgtgtgtaat

SEQ ID NO: 2377 - DNA, 1700 bp, artificial
  synthetic oligo
agttgtcaccacaccctcttttagaagggtggggggttaaaagaagaaaatgaggcacagcaaatgtgacttgcctgtcattactagtgacagagaaaaggaacactcaaggtttctggaatttatcctgtgtaaaaacaaaaagaaaatcaacacacaaacacattccagagccaaatactgtcttcttttaatcacctcctgttttggattatttatgttttgttccccccagacattcacgttaacaattgagatttaactttcttggtaaatcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacata

SEQ ID NO: 2378 - DNA, 1250 bp, artificial
  synthetic oligo
gatatttctaagtagcaaagcattcaagatgtgacctgtcttcctgaaagcatacaattatatgcattcataaagagatggtttgaaacttatgtttaaaagggaagcaggacataaaggtttggaaaatttgcagcctgaccatgtggtagaaaagaaaaacccattttcttgggagaaattcaagctggctgcagaaatttgcataagtaatgaggacctgaatgctaatttgggggaattatcttcaggtcatgccagaggtcttcatggcagcccctcctatccaaggcccagagacctaggagggaaaaatggtttcatgggctgagcccagggccctgctgctctgtgcagcctcaggacatggcaacctgcgtgccagctggtccagctccagctgtggctaaaaggggccaaggtatagcttgaactgttgcttcagagggtgcaagccccaagccttggcagcttccacgtggtgttgggcctgcaggttcacagaagacaagagtttgggagcctcttcctaaatttcagaggatatatggaaatgcctagatgtccaggcagttagtctgttgtggggtcatagccctcatggagaacctctactagggcaatgcagaggggacatgtggggtaggagcccccacagtctccactggggcactgtctggtggagctgtgagaagagggccactgtcctccagatcccagaatggtaggtacaccaagagcttgcaccttgcacctggaaaagccacgggcactcaataccagcccgtgaaagcagctgtgggggttgcatcctgcagaaccacaggggcagagctgcccaaggtcgtatgtgcccactccttacatcagcttgccctggatgtgagacatggagtcaaaggaggttttggagctttaagatttaataactgccctgccaggttgtagacttgcatggggcctgtggctcctttattttagctaatttctcccacttggaatggttacatttatccaatacctgtaaccccattggatcttgaaagtaactaacttgcttttgattttattggctcatgggtggaaaggtcttgcattgtctcagatgagactttggacttagacttttgggttaatgctggaatgggttaagactttgggggacttttgggaaggcatgattggttttgaaatgtgaaaaggacatgagatttgggagggacaaggggcagaatgatatggtttggctc

SEQ ID NO: 2379 - DNA, 1150 bp, artificial
  synthetic oligo
ttatcagatataagtgtattggtggagtttttaggtttttctagatgtaagatcatgtcatcaacaaagatagacaatttaattttctattttaaagtttggatgtcttttattattttttcttgcctgagtgctctggtttggaattccagtattatgttgaatataagtggtgaaagttgacatccttgccttgttccagttctcagagaagagtccacgtagtctttatttgttgaggtatgttccttctgtgcctcgtttgttgagagtttctatcatggagggatattgaattttattgactgctttttctgcaacttgagagagaatcatatggcttttattcttctttccattgatttgatgtatcatatttattgatttgggtatgttgaatcacccttgcatccctgggataaaccccacttgaccatgctgtatcatttttttcatgtgatattgaatttgatttgctagtattttgttaagaatttttcgcgaaggcccgcggcgggtgttgatgcgatgtgatttctgcccagtgctctgaatgtcaaagtgaagaaattcaatgaagcgcgggtaaacggcaggagtaactatgactctcttaaggtagccaaatgcctcgtcatctaattagtgaggcgcatgaatggatgaacgagattcccactgtccctacctactatccagcgaaaccacagccaagggaacggacttggcggaatcagcggggaaagaagactctgttgagcttgactctagtctggcacggtgaagagacgtgagaggtgtagaataagtgggaggcccccggcgccccccggtgtccccgcgaggggtccagggcggggtctgccggccctgcgggccgccggtgaaataccactactctgatcgttttttcactgacccggtgaggcgggggggcgagccctgaggggctctcgcttctggcgccaagcgcccggccgcacgcaaaagagctcctgaaggaagcgctaaacatggaaaggaacaacgggtaccagccgctgcaaaatcatgccaaaatgtaaagaccatcgagactaggaagaaactgcatcaactaacgagcaaaatcaccagctaacatcataatgacaggatcaaattcacacat

SEQ ID NO: 2380 - DNA, 1400 bp, artificial
  synthetic oligo
gcctgtagtctcagctactcaggaggctgaggcaggagaatggcgtgaacctgggaggcggagcttgcagtgagcggagatggcgccactgcactccagcctgagcgacagagctagactctgtctggaaaaaaaaaaaaaaaagagtgtaaccactctcttattaaggaatatatccagctatggcactgcatctggaaacctgccagaggcaaaggctaatggaagctgcaggcttccgagttacctgccagcactttgtattagcatttactagccaaggagctcaaagtcctttaactaagaaatggccctcagagaccttcagcagctggaaaaaaaaaaaaaaaagaaaaaaaactgcactggccaggctcagtgcccagagagttcagaagggtagtaccggatcagtgcctgcctgcagcagaatggtcaaagcatttgatccagtaaatctccaagtgtggtccctggaccagctgcatcagcatcacctggaaaccggttagaaaggccaattctcaagccccacccaacacttaacgaaatcagaaatcgtagtagggtgaggtccagcaaactgtgttttaacaagccctccacgtgactctaatacaggtgaaaatttgtgacccaccatcccagcctttgccttttcctcgtatttatggaactctcctcactcacactctcttcatttacctcttactacgtttccttcatcaaaatctgctctcagtcagggatcgaaaagtcattcacagaagtcaggagggcctgacacaagcttgaagttttacccttcagagaactttgtcctttagcgggatcaaaggctacctattaagctgaaagaataaaactctaaccgaaaatttatggaatcagcctatgtgtgggaaagactggtgaacaaaaaagccttcccggcacctttgcagctatgttactgagcccatggtcactgctagccactatggcacctttgtgctagttagaaagggtattttctctcaaatttaaaaaatcttaactttgtgagtatatcatcatacagcctgtggcagccctgtgatgttaggcagcacaccctggctgtatacatacaagtaccatactctcatttatggatacatcccccagacaccagggagcacattccactagcagcatggatgctctgcacatcaccaaattctatctgcccagtgaagcctccttgtcacctttggagtcaggctttaggagagggggtgagaagtcgaaattggttctctgagaatattaggcaggagagaaaagcaacctcaagaaacttctggaacatagtcaagatagtacatacccagctacacatgagtttaccagtgatgatgtatgtgcatagctgggagtgc

SEQ ID NO: 2381 - DNA, 1900 bp, artificial
  synthetic oligo
tcccagaaaggaaaactaaaaacaaaaatatggaccatataagataaataataagacaattaaaagatcaaccaaggacatcttatatcttatatatcttatagtatttccagagagaagaaagacaatgttgttgaagaaattatcaaataaacaatagaagaaaatttctcagaaggaatcagcttctagattgaaaggctccaccaatacagcatatcatgtgtcaaagactcatacatcatcatgaaatttcatagcatcagaaataaacagaacattttaaaagtttctgagaggacaaagaggaatggaaataggttgtatcaaaagattaggaataagaatgacattggtgttctcaacaccaacagtggaaattggaagacaatgtgacatgtcttcaaaggactgagggaaaatgatttctaccctagatttgtatactcattcaaactatcaatcaatagtgaagatgaaataatgacttttcggacatgcaaaatctcaaaaatttacctcctgtaaaaagctactacaggatgtgctccacaaaaatgacagattaaaccaagaatataggtcatgagattcataaaacatagatcctgcagagaagagaaagaaagaggcgtttaagaattatgaaaatagaaaactagcataatattaatagctgtgcagcagccttagggagcaaaatgtttagattggaataggaagacagagagccccagcaaaaacaaatgaaattcataaggtatttaataggctttactatgcataaaattgttttgacaggattttacagccttatcagaaagtatggaaagacttagacattcaaattaaggtaaacaaattaaaaattgaagtaattattaaccccggtaaaaatgaagttacatgtgacaagaattataaccatattatttcatgtggattagcaataaatgatatttacatagttactatgttaaaaatactaaatatggatttaactataaattgggacataaccatatttaaggtttaaaggagagtaaggaagtacaaaaagactaagagtgctcctcaactataatagtaatacaacaaataatgctcaaaattgattaatcgagagtcaccagtagcagcatagcatttagaaacatagaagtaaataccagaataaagagctaaaaaaatatgaaagtggttgcttctgatgaagggaagaaaggaggccttatagactgctttgttattgatataaaccttttagcatttcttgacttttaaaactatgtgtttgtatcgctttgatagctttttgttcatttcattttttacttgttaaagaagcaagggtacaaattaagagatgttgcagaccactgctgtaggcaatgctccttgtacatagaaatctctatttcattgaaagttattgggcaagggagaaatacagccatcttgttaatgcatttgcttaaccatttattatctgtctctctcactaaaatctaaggtctataagggtggcaatgagtgatgtgctagtaagtgtttgacaacagctatatggagagggaaaaaaaactcttatttgtagcatttgcctgtttctgcggtgtaactactactatcatgcctgatttcaagctaccaattgatgtcactgaatggagagctgggaaaagatgcacagaatcaacttttctggactggctctaacataccattgctagaaaccctgtctgtcttgtatagtgttctatcttgggttcaacatattgcctagcacatcagaggtgctcaataaatagttgttgacctgttgaccaaatagggaacaaacaacagaagcccagggataggcaaatatcaaactacataatttgatctgagaatatgc

SEQ ID NO: 2382 - DNA, 1550 bp, artificial
  synthetic oligo
caatggtctgggctcaatctcagacctaataattcactggctttggatgttgctgaggagaaaagacaagcctgggagaagggatggaaggagtaattagctgggggaaggtgagggagaatggtaggtagggacagttgggaagatactgctttccaaacaactgaaaataaaaggagaggaagacgggagagagaaactaggaaaaacagcctccccagacaggtaatttataataactgggaggaaaatgagaactgcagctaaaaatatgtatacactcacaaatccctggaaggccagtggcaaaactaggaactaggagacttcctacctccatgcccctttctcccatccttctcaggccctatattgctatgcttcctaaggcccacactgtggtagactctagacctagcctgccctcttttcaaatccctcaggcctcaccctctcctttcgagctaaatctgttaactcattactttggaggcaataggcttttatcttggggttgttgcattttggctggcagtatctggaacaataccataactgaaaggaatatttcattagtcttggtgtcagaagcgtttgaaccatagcaactccatcttgagcagtggctgggtaaaatgaggctgaaacctgctgggctgcattcccaggagattaaagcattctaagtcacaggatgagataggatgtcagcacaagatgtaggtcataaagaccttgctgataaaacaggtagcactaacaaaggcggccaaaacccaccaaaaccaatatggtgacaagaggagtaacctctggtcatcctcattgctacactcccactagcaccatgacagtttgcaaatgccatggcaacgtcaggaagttaccctatatagtctaaaaagggaaagcatgaataatccactccttgtttagcatataatttttttaaacataaaaataggcaaccagcagcccttggggctgctctgcctatgcagtagccattctttttatttctttactttcttaataaacatgctttcactttactctgtggactcccctcaaaatctttcttgctcaagatgcaagaaccctctcttggggtctggatcgggagccctttctggtaacatttttctggtgaaccccaagggatgatactgaagaaactcgtgaccaaaaggaaaatcatctgtgcacaccaattggccgactttgggtaagtgaggtgcatatacctgggtaaaggatgggattgggttagaggcccaacttaggggagttagagtctctcctaagacagagagggttaaagggccctctcaataaaaggcaacaacgcttgaccaaacttgggttggaggcccaattgaggaaggttagagtccttcctaagatttaggaggttagaggaccctctcagtaaaggtactctcagctacgaacaggtttggcactatgggatgttaacggctattctctttgaattaatctaccttgcagtctgctgatggctgtgggtgacaggatgaggcatgtatggg

SEQ ID NO: 2383 - DNA, 1150 bp, artificial
  synthetic oligo
tagttaaatttaaggtgctacgaaaccactgagcaaaagaagagggtagagactttgtaagcaaaagccagattgtaaaggaccttatattaatatatcatagccaagcagtgggaagagctctgttaacaatgcaatgttgtgggataaagttctcactagtgggattggccatataaccaactgcttcctaagtgttgaaggaaccgatggagataaatcctatcttatgacagaaggatcagatgaaaaaagagtgtaaagacaattaatcaactggcccatgcccttcacatggacaaaaacttgaaagctggctgtcttgtacatgtgttttggccaaaagcaaaatgtgccctcttgagagattacctggtgttagtagacagtccaggcacagatgttactacagagctggatagctggattgataagttttgcctagatgctgatgtctttgttttggttgcaaactctgaatcaacactaacgaatacggaaaaacatgttttcacaacatgaatgagtggctttccaagcctaatattttcattctcaataatcgttgggatgcctctgcatcagagccagaatatatggaagatgtgggccacctgctgaaggatttcaggcaagattacaggaatttcagaattttgaacaaatctttgaggagtgtatctcacagtcagcagtgaaaacaaagtttgaacagcacactatcagagctaaacagatactagctactgtgaaaaaacaatggattcaataaacatggcagctgaacagaaaaggcattatgcagtggaagagaaggaagaccaaattgatagactggactttatctgaaaccagatgaaccttttaacactggatgttaacaaaaaaaccagggaggttactggggaggtggcaaacaaagtgtcatgtgcaatgacagatgaaatttgtcaactgtctgttttggttgatgaattttgttcagtttcatcctactccagatgtattaaaaatatataaaagtgaattaaataagcatatagaggatggtatgggaagaaatttggctgattgatgcaccaatgaagtaaacaccttagtgcttcagttccagcaagaaattgttgaaaatttgaagccattacttcca

SEQ ID NO: 2384 - DNA, 1000 bp, artificial
  synthetic oligo
tctagaaaacaaagtgaaggtttccatgaactgagcagagaaggttgactttataggcagaaaagggctgaagaaagaaacagtgaacaaaaagtgatgggtcatttcaaaattactttccttgtaaaggttaaaagagagaggactttcttatcacactggctaaaactggcctgtttgggaatttggctattatctctgcctttcttggtttgtcagaaagtcagacaaataacttagtttcgacttggtggcatgaaacttctgcatgagtaactccattttggtttggtctgttggacccagcacaagggctcattctaaaccaatggcctcctataaattttaacagggttcttcagaaaaatttgaaaggacccacatcaaactgttaacactgattataccccagatgttgtataggaagggaaaactttttttttccaaatacatctttgtatataatttaaaacgagcaagtcgtttaaaaactcacttagcaaaaagaaattcagggcagaaagagaacgcaagaaagactgcaagcagcaagacagataggtgaaagagagtgagaagagaagagaaaagagaagagaagacaagcaagacaaaagacaagacaagaaagaaaaaaactgcaatctgtggttgaggagaatgggacctaagcagcgcggagaggcaggcgcgggaagtcagccgcagccacaagccttggagctgctaatccccgtgcgtctgtggccagctgcctgcagcagcctggactggcgggcgccccagttatgtgggaagaagcagaacttcacagtcattgaaaccgtacctaagggaaacagagtggagctctgaatatatatcgatgggagcgactgttgcagaaagcagaccagaaaaaaaggcagacgaagcctgcaaagccaggctgtgggaagtctgtccacccacagggtcagctcgctggtgacgctccagtgaaaggctctggctgcgccac

SEQ ID NO: 2385 - DNA, 1600 bp, artificial
  synthetic oligo
aacatgacacaaccccacgggggcattgggtccctctgttctggatttgcctccttctgcttcacttcagttgtcttaattccattcaccttggttctctgagccccggttgacacagcacactggctctctacgctcccctctgtctccttctgctgccatgccctattgtagccatgtccttccatctggcactcagaaatctttcccaaatgtcattctgctagtctcctgacaccttcacacaatctgcccatcctcttggacagagctgacatggtccccgaggctggggatgctagaggccacctagtagccactaggaagcaatgcttgtactctgtgccctgtgcactcagtgacaggcaaggaggctgtggaactattctcacaatcatccggacctgtcttctcaaccccattggtgctgccacctaagagattaacaagggaggccactagactcagattgctcagatacaattataactggaaacattgggttctaaggaaacactgcataaatcacactcttccctagctggctgactggcaatacggtgggatcccttttgcaagccagaatatgttggaattatactggagtgatgtggactatactggattttttcagatttctaaactgctttaagaaacattccatagctccacttggcaagatataaacaaacttgtaggaaactgggttagttttaccagtcaaatgagttggcagcccaattcttctgtctcaaagagattaatgagcaattaatttcccagaccagctaagcctgggaacttctgggagctaacggattttacctgaaggtgaagtccagcccacgtccgtgggccaccacatcagaccctcccaagaacgcaagggaaggcctaatttacatagttgccctgccccctagtgtccacaggcagcaataacagcaggcaggactcaagcttctaggtatgggcagcagggctgcagggctttttttgtgctccacacaatggcgcctggctaaagggatgtgggaatgaaattaagctcatgctcttctcaccaagccttgtgccctgcacaggactgcatccatctggaggttgacctcttttttctaatctgtctgccaagaggagccatttttttttttggtaattctattttaaaaatttccacatagcttgagatttctaatgtctaaagctaccagaaaggctgataccaatcccatgtgataggccaggccgtcggcatgtactcaaatgtatattccatttctgaaaattcacttgtcctataagaatagctcagggtgtttgtgtagaagtggccccattccagaaaattcccggactgggaacttcatagtcatccatccagctatgaacttctgttagctccacccccaaaatatatcctgaatccatccacatctctccatcttcactcatttctgatccaagctagcagaaatttcttgctacaatggtagcaatacagggaaaaacattggcctgctacaatggtctccctgctgccactctggcccctccacacagcaaccagaattatttattaaaatatatgtaaattcat

SEQ ID NO: 2386 - DNA, 1100 bp, artificial
  synthetic oligo
gtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaa

SEQ ID NO: 2387 - DNA, 1600 bp, artificial
  synthetic oligo
tagtagttgtaaacacgatcggatctgcacttcagggtgggtgcaaagctagcatatgttcactaagcattttccatgaggtgcgtaaactgtagaaactcagtgctctggcaacaaagaacatgagagaaaattaccaaatgcagatagacatattgtaaaccgtggagcttaaaatgtaaacctacttgctaggctgatcatagaggttcttctcagccccagagaatttgtgtaagaatcctgtccatgcctttatttacaccattgattaaaaatgctaatcaggagaggatcaaggctatggacctccttctaggttgttgcagaactcccactctggcaatggtattcagctggttttgaatttttctgctttaagaactatccctgggaagactagtggtctgaagtttgcttggagagtctcaagccggaaactgatttgtggtccaaatgcttaatggcatcagacacttattcctacaagagaggcatgtggtccaaggggtggcacaggtcaaatgtgatggccaagtcccgcctcagcagggcttgaatccgcacttggcaacttttatttctctctgtccattcctgtggatactttatctgtgttaatgtcctcatttaggctaaggtcaaactctgttcttctctcttctggccagaaagacttcctgttttacaggtatatgatcttatctgtgttgataccttaactgtgagtgattccctaaagcaggtccttggacaagtgcccatcctccaggaaaattgcagcagtccaccgtgcaatgagaaagcctgaggactaggtagtaaatgtttcgcagagaagagaaatctatttcatgtattattctttattctgaggttatttccttctcttttggtgttgaaaggaagccccttctttttagaaaatgatgatttgtggttgttctgtttcttaatgattttacttgggaaaataaaaatctggaagttcaatatcagtccctgaaattttgggttgcattagctgcaagtctgggaacctggtctaattttgagtgttctgctagtacctctaggtacctcctattgccacttgtgttctaagtgcttataaattacctgcttcgcaatctgcagcagaatctctccgaggattgacatcaagcttacagctttggagtttacggtatactggtctgtagtttccttatttaagaaaattgggacactgcccatttgcagtcctctggtatccctcctgttctctctgattccacagatccttcagaccggcacctaatgcaaggcagttccgtttgctcttcttataatgttcttttccctatagagttggacatgcatatacatgttgtttggggaatttgcagcacatccaatgaaagcataattcccaactaacagtcaaatccttttctttggagctacccagaacacacctaccctctcttccatatgacagcccttcagagacttgaagacagtgtgtgactctcctgtgagttaagagcactggctgagtcagacagacccgagtgacaagcccagcttcgctccctctcagcggtgagagccaaggtaa

SEQ ID NO: 2388 - DNA, 1650 bp, artificial
  synthetic oligo
ggcaatataccacgttgcttccagagcctagtgtctcaaattctgacccccgtagtcagggacaaaaaatgaggcagatggccagaggataggatagggagcctttcgcccatctaccctgctacattaactttaccatgtattcatcagcaaaatgagaaaacaggctcaggaatacaggcagtgattaaggggactgcagagtcccttgggtagctcagggtggagtacctaagtgacctctcaaagcgccagagcataaagaaatgcaggccgagtggggagggacgagctgtgagttcgaattcagagacccccaacttgctttggtcagaagccttgggccccacctccatccaggttgctaactgctggagcacagaacaggttggggtggcaggggaatttggggcaccctggggaaacttccagggacggctccggccaagagaaggcaacccacctgtgcaaaggctggaaaaggaggtgagggaagcgggcgccgggcactgctcactaacctgggcactggccttctccgtctgccacgcgtgcacgcgctccgagctccccggggcgctctcgtccgaggtctggggctggcaggttgtggcgagagctagagtgcgcgcgaggggggagggggaactcaaaagtgggtgggaggaaaaacatcaccgccctcacaccacgagggagcagcggcttgctcggctcccgggggcagagccaaggcgcgggcgcggcggcccggggccacctgcccgccctcccgctcgctccccacttggcccgagaagccggccgctcggcgctggcgggaagtccgcaagcacgcagccgctgcaagcacgcacactttctccaccccggcacaatggctttatttctgctcccccggcccgaaagtttaaaaatcgggagaaagtgtgagactcagccggctactttcccatcacacagcgcccccactgcagcccccactcctttggctaggcgagcgttggggtcttaaagggaccgcacagctcctccggtccctcctccccctctgcactggatgcacctaggagctccccaccactcgcgcacgccctgaagataccgactaccctctgactcccctgcctggaagcccacacccgctctcctccggcaccaaggcctttccgaggtgtgcacctggtctggtactgagctggtgccctggacacagaatgaaccctcctcgcaaatcacgccctagcatgctgcttatcatttcacggcgtttcccatatccacactgtggctaacagagtgacaaagctttggtttggtgtccttaaaggcggggtggagatgggtgtgtgtagggtcagggattagaaatccactttctcttacaaactgggctcccaagcctcatggaaagggcctgttctaactgttaagtgtcttgaagaaaacttggtgccacacactatacccaccattttttttttaaatgagtccctaagcttctaagttgggccaagagctcaacctggaaatcacagtagcactgctgatgccttggtgggcctgcctactccaaatttgtgtttattcaacaagtgatagttgcaaagaattgtcagaaacttctagggtccaggaaagtgctgcctc

SEQ ID NO: 2389 - DNA, 1050 bp, artificial
  synthetic oligo
gagatcctactccctccagcccatatttaaaactggttttcttctgtctatttaaccctcagaaagttcacaaaccaactaaccaaccaaccaaccaaccaaccaaccaacagaaaatccctaaagaaagaaaaaatgacttctagttcctgaagttagttatttgtgaattacttgtattgataaataaaactgtcagtttccaatatcacatctcttcagggtaataaataatccttggaggtgactgccattatacttatgaaggttggaactgcattttacaagataaggaaaatcactgaagtcttatacctggtcacaatttcatcttaaagaccctagaaaaatgctgaaggcggccggacgcggtggctcacgcctgtaatcccagcactttgggaggccaaggcaagtggatcacgaggtcaggagatggagaccatcctggctaacacgatgaaaccccgtctctactaaaaatacaaaaaaattagctgggcgtggtggcgggcgcctgtagtcccagctactcaggaggctgaggcaggagaatggcgtgaacctgggaggcggagcttgcagtgagccaagatcgtgccactgcactccagcctgggcgacagagcgagtctctgtctcaaaaaaaaaaaaaaaaagaaagaaagaaaaatactgaaggcatctcaaagataattttaagtttaccacaaatattcatataaggtggacaagggggccacagttatgaaacataactttagtgtttcagattcctctaatcaaagatgtcattaacaggccgggcgcggtggctcacgcctataatcctagcactttgggaggccaagacaggcggattgcctaagctctggagttccagaccagcctgggcaacatggtgaaaccccatctctactaaaatacaaaaaaatcagccggcacggtggtaggcacctgtaatcccagctactcaggaggctgaggcatgagaatagcttgaacctgggaggtggaggttgcagtgagccaagatcatgccactgcact

SEQ ID NO: 2390 - DNA, 2150 bp, artificial
  synthetic oligo
ttaaagagtttatgggaaaggagacataatataaatcatcaataaaacatcaaaaaacctatgacaccaacaatagacaattatgaatgctgatatataaatctgtcattcttgttaaatgccatgaagataaatatatggcaatagaaaagtgggtctgggtgtgccatgtcaatgttgtaatcatttcacatttgaagccaagggttaacatgcacaatctctaaaaagagcattatcaattagtctatgtctctcctactcttataataaactcgggtaaagttcagaggttctatctttcaggctggtttccccgcttcaggcttttcctgagggagtaataaccttgctaaacacttaaccatcaccaggtacatgactgcgatccaaagagcccaggttgtaatagggaaaaagcccttctagtctcattctaagagaccatggagaaagatcagcatctgtgaattcagctcagtacctgcatatgtgggacatgatcatgaccatttgtccgagtcgatgtgtgtctagggagggagggaggtgtccactttgaagcagagatctgactgatgcccctccatttgcatttcttggttcctttaaggaagacaggcaaacaaatctggccatttcttaagtttgaaggatacaagacaaagaaggtaaatggggaccctggttcctgaaccttcatgatccggctcctggctctctatttctgaaggtggcttttgacgaagggcaggtatccttggtccgagggccacactaatcgattttaaggaggcctgggagcaggttccccacggatcttaaaatctacccaagaatggagcaaatcattgtccagggataggacaaagctgtggttcaggaaaatattcccagtgaaaggatgtttttggtcatcgcaggcagcaccttgtcctatcaaccctggagcttctccccattgcatttcctcttccaaaacaatctgttgctggcctccctctgctccctaccaccctgagcccacagccagccagtcaatgcttctccgcctacagcagcccagcatcttcattcaacccgcacttcgctgccccttgcccctcagcagcactcaggcagtgaaatggaccgcaccggccgcctgtagacttaccctgagccaagtggttttttcggataaaatctgtgtcgtctggatgtccaccggccaggatgcgtggtgcggcgccttgccggactcctcttttgcggcgcgaaacagcagccgactgggacagcccggggcctctaggctgatgggtgggtgggcggatgagcacagggaaaggggcggggtgtaaagacgagcgcaagtactggctcctaccttggcttcccctttggatgctcagttattgccaaacttgcctgtaacagatcggccctcctcacctttcaccttcgccagtgccctgaaactctttgctctaccaatgtccctaccctgttctcccagctctctaacccaacctgagccccttcaagcgcacccactcccttcacgcagccagtcacacacaataagagctagggaagaaactgacacggggaaactgacaggggtagctgacactgtagtgtgaaggagagggagaaggagggaggaaggaagggatggagagagaggggagagagagagaaaaaaagagagagagccgcattcacactcttacacgcacactcaagctccagctgttaggtagcggctggcgggagcgctggctacccctccaaaacccttttctacactagaggtttctgtccccttctgctgccgtttctggaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccg

SEQ ID NO: 2391 - DNA, 1150 bp, artificial
  synthetic oligo
gattcccacccctccaaccatatactcttgagaaatcagagaaactccagtgctttgtggagtggagcaaagcactggaaaaccactggaccgctaacactcttacaaatattagattctgtgggactaaattatttcagacttggacatacagtttggtattttccttactcccatgattttaagaaaaatgcaaattgcagaaacggacatctcactcctatagatcattcttacactcactggaaagaaaaggtaggccttcatgtcctatgattgtgatccatctagagtctacttccactgaactcccatagtacttttaaaaaatagctttatagaggcataattgatacaatatcaactgtataatctaaactgtacaattagacacattattacatatgtgtacacccagtgaaactgttattaccataaggataatgaaacatagccatcagtccccagaatttcagcaagctcctttggattttcctcctagccctcagaaactgctgaatggcttttggtcattataaactagtttatatttcctagatttttatgtaagtggaatcttattatatgtacttttttttggtctggtctcttaactcaatgtaattattttgaagtacatctatgttgtaatgtgtatcaacaacttattccttttcatagatgagcagtattttattgtatggatgtagcacattgtctattagcacatggatggacagttgagttgtttccaatgtctaagtattacaaataaagttgttatgaacattcatatgcaaatgtttgtaaagacatgctctcctttctcttagataaacatgtaggaatagaatgactaaatcatatgtgtatgtttaacttttaacattttaagaaattgccaaattatttaccaaagttactgcaccactttacatttccatcaacattatatgagatttctaattgctttgcatccttaccaacacttagtaaggtcaacctttttaattttaggcattctcatagctgtgtagcaatatctcattatggtttgagtctgcatttccttaatgactaatgatgttaagcatcttttcatgtacttatcagtcatctgtatgctttctttgttgaagtgactatttaa

SEQ ID NO: 2392 - DNA, 1000 bp, artificial
  synthetic oligo
accataatatgaggctccggtgatagccctgggaactctctcagaagcagagaggtagaggcagaaatccagaccaagtgtctttactcccaattcagtgctctgccctctgcagttttgttttcatcacacccaaaagcatttttctcttacagggcccttgacctgtaagccctaaggagggggggctcctaagtcaagttgtagtagactcacctgagcttctcttctaacccccttcaacaaaaatctcctgtagtcacctggcagagcagacaggagccagctctgaggtgggcccattgccaagcaacttcatcctccccagcttattccaaatctagtctagacaaggcatcagaactctcattctgtttcttcagctgcttgtcaggtcatcccctcatttgagtagcaaggatatttctattaggtacatgccccatgggatcagggaaagactcatttctctgaatgaagagaataaatgcatagcatgccattagcccaaagccctaggcaggaagaaaactgacagagtggtcagctccagagtgaagagctggctagaaaggccccaataaacctcactgaagtcagaaccaggtatcactgagctaggagccaacactaaagtgctcctattgccaccccaagtgccttgtgaattccctctcacagaaatttctgttagacctctgaaggcatctaagccccagactgctgtcataaaggaaactaaggagaaagaggggaaatgtatcttccatccacatccctccccacaactctacctgttatctaccggaggaaaaaaagagattatattcattggcactgtaaaagaaaaagaaaaagcagaccttttaagaactaccttaccatttggaaagccactgtcagcactcagttacttcacagaaaacttgcatgctgatctgatggcccactgaggaaatcgtctatggaagggtgcaaaagtagggagcaggtggcaatg

SEQ ID NO: 2393 - DNA, 1100 bp, artificial
  synthetic oligo
cacgaagggaccctccaaagtccctctcatcatattctcttgggaagtgcacaccagtgggttaagcaacccagtcccttttccattcctcccaatgtgcctccaggactcctgtacttgaactgtcaaattgggatattctgataggctgacaagcataatatataaatcctttttggtgcccaaaactagagagatgactaccaaattacttttccctgctcacaaactggaaacaggaacaagtatggtgttaaagcaaaagtgatttacaaaccctccctgtaaggcagggaaatgcagacactgagctgccctggaccctgaaaagtataccaccccctcccacgtcacacccaccccacccagcatgcacacaggcacacatgcatacacacatgcacgagcgtgtgcacacacacacacacacacacagaaatattccatacctatttctgctttcttttaggcttaaagccttgatcaggatagggaattcttgcttatgagcagctccagaaaccgcaacggcagattccctctcccctaacactcaggttcagggtaagcgccgccaagagtccaaccactggtcactctgaaatgttcaggagagggagggagggagaaataaaaacgtcgtttctattttgccaccaatggccagcagttaatcaaaccagttcttccaagagaatgacttgtcctcctatggtgcttggcttttaaatgagtagcagagtccatctccactagggcagaaaagaaacctcagtgtccagtagctgtgtccggaaggccaggccagtctccagtgatggaaatgttcaggtctgagacttgctctgttctgacctcacagccctagaaagctaccacttccattccaagttggaatggtggatgatgacaaaagccaaaaccactgtcacctttagggtgcaaactttaaactgctattagtagcaggggaggttagtgaggctcactgtcccacatcccagaagggagggcagtcatcataaggtaggtttttggtcaaaaaaagaacactcagtgaggctcccaatttgagtgcctcaagctcagataggtggagg

SEQ ID NO: 2394 - DNA, 1150 bp, artificial
  synthetic oligo
tgaagaaaataatcaaattgtgacatattcgtgcaatgcaatactactgaacaataaaaagggattatctaaaaatatacataaaatatgaataaatctcaaaaactttatattgcacaaaagaagtcacacatgaacattttatactgtaatattccattcccatgaagttctggaataggcaacattaaatgtgtgaagggattgattgggaaggggaatgagggaacttaactggagtgttggaaatgttcttggtcttgataggtgtgagttataagggtgtctgcatttgtcagaacacatcaaactgttcacttacaatttgggaaatttactctgtaaataataattcatactaaaaattttcattcacaatctcaccaaattaagtattattcttaatacattattcttctttattcttcaagggtccccttgaaggggacctttattcttcaagggtcccctatttgaatcaaaataaaacacaaagttcatacaaagcctagaagaatatccaaaacctgaccccaccaacctttctaatatttttttttctactcttcttatgaattctgctccatccacactggctttcaaactatttcttgaatattctatgcacactcccaactcaaggcttttgatcagcactccctctgcatgggtccctccttactttcttcaatatttgctaacatcccactttatcaaagaggcttactctgtccatcctatttaattttttaatgaggtacaagtcacataacaaaaattgtacgcctttatggtacactataaagtggattttatcatatttgcaaagttagacaaccactatctaattaaggaaaactttcatcaccttgaaaagaaaccctgtatccattaggagtcaatccagaatcctccctctcctcatttctaggaagtcactaatccactttctgtctctattgatttgcctattctggacacttcatatgaaatcatatgatacctagactagtgtgtctggctataatgttttcatgttgcagcatgtagcagaaatgcatttatttttatagctgaacaatattctactaaaaagatataacacgttttgtttattatccatcacttgacggacaatttggttccttca

SEQ ID NO: 2395 - DNA, 4700 bp, artificial
  synthetic oligo
tgccttcctacacagcacacagagttctactgcgttatttttttattaaaaataatcctaccaactttaaaaagactgtgtataataagctatctatgtctaagatttttttctaagtctatgaccatgtttgaggcacagtaagggaaaagtcaattgtgttcgatgtcataaaagtttatttctaggtgtggcatgcctcaacgatggacattatggatctgatgctgggtttttacgattaagtagtaatagcgaatgctgaaaatataatttgatacaattgtattactaccaaaaacatatctggctatgataatttgctttaaaactgaaaaaatatgggtagaagtattatcaaaattccttgcatttatgtcctgtggtaaataagaaaaaaaaaaaaaactcccggtagaattcttgtgtagcttcttttgatctgtgaaaatacctgccttcgagaattttgctagaatcctgtcactcattttttaaacctgtctgtcatcctttaggtgtgttaaaatagggctctctggtcaagagggggaaataataatgagtagagaagtaaactttctagtcagtttatttttttaaaaagttcccaaagtttcaaatgatgaggaactttttcctacgtagtaacaatcttctttaattctttcccgaatttctaaatcagtagttttggaaacatatgtatttgtagtaggaggaaatcgccccggttcgaaagttgtaaaaacaagtccacagccttagaaaccgggaaatatttggaaaccgtgttccggggggcactggggattttaatcaaacctgaggaattcactgtaaataactcctctttccagggacaatttccatacacctgaggaacggaaaggaaagcagtgaaaaccctgggctgactccccaggcctcgttaggcaggggttccagaaaacctctctggcaatgacagagcgacagaaagcgccagcatgtgcttgttttgagtttgcttccccagtcctaaagtgcgccctaaatttctccttacactaaattctctggtctggtgttgccaaaatctccaaagtccgtcggaccttgcagcgctctgccgagccgcagcctagagaacctgaagaggcagtacgcgccgcaaatgccaagaaagcagagccttcggtcccggcggaacccggtaccccgagcctcgccgcggaccgctccggctcagtcttacaggctctgggccgctcggcgagcgccgctcaaaggctaacgtgcctgcttgtttctacccgacctccgaagcccagacgtgcttcagcaagccgcgtggctagcaaactttctctctgctgctgcgggaaccttcccaacgaccacgtgggtttcacccctggtcgctctcggcacttttgcctttcacaaggagaaggagagaacagcctttagagcgaaatatataataataaaaactattattaccatcatcctcatcctcataattgctattatcatggtcaatttctccaagccggttcccccgggagccggggagcgagaacaggttttggcggatgctaacttccactcgctgctcggcagatccattttggcttagcaaaaatatcacagggatttatatttacattttttgaagtaatataaatgtctcagcctctgacaaaataaatacgagtcccgccagaaaaggcaagactaagcattccacattcatagagtaaggggacacttggggagtttttaaagatgagtgcttaattatttaaagagaagacatacgttttctcttccatatttataaattactgttcgctaccaaagcatttctaaagatgcgagcgttgtgcagtcggtggacttggcagcgctgtcgcagccacctgtgcggcatcatacagcagcattcaacagatgcttcaagaaaactgcgatgggtttttgcttttcgaaacagaacttgggtgccgacagtatgttcactgccaaattaaatttcaaagcctgaattcagtggcgatggagggaatcagaggattcccaaaatgccccttttggaatagactggacagctcctttcacaaatatggaaacagaggcacagagagaaatgactgttcctagggcatccagaataaggaaggggcctgacccttatcattgcttccacttccttctccatctctaacttttggggctactgaggcaaacttcggccttcagaatagccggcagctcccaccccttttgcgttctgccgggttaggtcctccaagcctctctctgtacggcctctctgtagcctcttctatacactcgctgcgctgccgtccggtcctaagtagccaaaccggaggctcgatcttttgcttcggtccagctacctccgacaggcggggagccaatctccacttttcccaccccggtcctcggtacagggccgagaaacctcggccgcgacccgagaccaccacccccgctcgccccttcgttccctcttaggagagatctgcttctgtccccattctccgtgggatcatctccattactcagcttggttttggtgcctctgagccaagggggccccgttcacccttctctgcgctgccgccaggacaccgcaggcacctgcccggttgcgcctgggagcctgtgaaaaagagctctgcctgaccggttagagctctgcctgaccggttgcagctcggcatcccagcagttgccaaaagagagcctttgtggttcacctcttgctgccttgaccttgcattgacagcacccctccctcccccacaacgactgggcaaccgactggctgtgggcccaaggccctgtgccagagagatatgttcacccccttggaaacccgtaagagctgccctcaagttgtctttctaatgaggcctgtggggtcaagaaaggaactaaactgtgccttcccggggctcgaaggccaagagcttttctttctcctttggggttagggaaaggatggggagacaaggatggggaagtgggccttataacaggattgtggcctttgcgcactcaccaaatgtttgaccctgtgagtgcctcagttgctactgttggaagaatgggcaagagtcggaacagagacccttgaagggagtttcaaagcttgatgaaatttgcaagacttgagaatgctgtttgttgaaatgaaatgtacaggggtgtgtgtgtgtgtgtgtgtgtgtgtgtgtgtttggggaggggtatgctatgaatctttgagggtacattcttgagaaagccttccctctctctctatccggtgccatggctgatcctggttccccctactctctaggccttgtgaatcagattaatcatcacccccacccccatctccaccatggggtctcgcgccccctgccagcaggctccagatgcactaagagaccggtccaaacaggcccgggggccacgtaatgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtct

SEQ ID NO: 2396 - DNA, 1050 bp, artificial
  synthetic oligo
gattgctgatgtttccctctgcaccctttggcacctggactgattgttgcagatgtaattaggaatgttccccaacatgccgttattcttctcacgattctgggagaaactgtacccctcccccatagacttatataggtggcattcaaattcttgttcccaactttttcatctgtttattaatcccacaagattgtgtgaatgtgtactccgagccaggcacgttggacttctaacttcctcttagcccaagtaggaaggggagactcaggcgctggggaccattctcctctccctgcagcagagttgcagtccctatccctcctgggtgcccatccccgtgcctattttcctggatccccacccagttgatgtgacaggctcgtggcccaatccccttcctggttcccaggccgactgctagcaccacccgagccaatggcggcggccgaggggcggagggggctggcaggaggggagggagcgctggctttagagccacagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccg

SEQ ID NO: 2397 - DNA, 1050 bp, artificial
  synthetic oligo
gtcactcattgatgggcatttgggctggttcaatatttttgcaattgcgaatggtgctgctacaaacatgcgtgtgcaagtgtcttttctgtataatgacttcttttcctctggatagatacccaggagtgggattgctggatcaaatggcactatggttaactttctgtggaagtgccaaattgctttcgataatattaaatatctatctacatcattttactttcccactagcagtgtatgacagtttcaatttctctacatcttcacatacttttttgtttgtttgttttgattttgtttttttgagaccaagtcttgctgtgtcgcccaggctggagtgcagtggcgtgatctcggctcactgcaagctccgcctcctgggttcacgccattctcctgcctcagcctcctgagtagctgggactacaggcgcccgccaccacgcccggctaattttttgtatttttagtagagacggggtttcactgtgttagccaggatggtcttgatctcctgacctcgtgatccgcccatctcggcctcccaaagtgctgggattacaggcgtgagccaccgcgcctggcctcacacacttgttattttcaatttggttttttttctagccatcctaataagtgtgaggtgtatctccttgtgagtttcctttgtatttgcctatttgcctaaatgaatgatattgagcagcaggtttttttttttttttttttttttttttttagatggagtttcgctcttgttgcccaggcaggcatcctgtactgagctgcttggccgtttgcatggagaaagcaaaggatttgcagcatgagagcctggcatgtttggttccatcctgccaccttaattcaccttggcaaaaccatttagcctctgtagaccttggtttcctggcacaatgagtgcttattgaatctgtccgttcagggaatgtagacagaaaaaaggctatgacttagttctctgtgtcaggcgatggacattcctcccttaaataaaggaggagaaagacagggaagtatccagaga

SEQ ID NO: 2398 - DNA, 1300 bp, artificial
  synthetic oligo
gcctcaatcaggtaggtctccttcgccttttctttcctttatttgcctttcctttccttgacacaggacacgagatcagggtttgtgccatgggcagcctttctggtgcagaggaccttccctgccctccggcttctgggcagccagtgccgggcgcgcgaccttgtgcaatggcggctgcagccgagctggctccagcgtcctgcaggcatcggagggctttcgggcgcgttttggacgccgagtttttgccgctgcctaagttttagttctggcaagtgtagggaggtccttctagtagagcctttctggccttccccgtcgggagcctggaagcgtctcctgtggcagggcgggcagagggagaagggtgcgcctgcagatttcttcgccccactggtgttctccccacctacatggctgaggaggtgtgcgctctcgttcggtttagattgagtggttgttaaaccacgtggctgccctgcccacaggcagggctccccgtaatgtaaaactgtagaagaaacatttcctctaacgaataattgaacaaaaagaaatacagcttcaggccgggcgcagtggctcacgcctgtaatcccagcaccttggaagactaaggcgggagaatcacttgagaccaggagttcgagtccagcctggccaacatggtgaaacgccgtctctaaacaaaaattagccacgcatgatgccgcgggcctgtagttccagctactctggaggctggggcgggaggattgcttgtgcccaggactttgcgactgcagtgaactgggattgctccattgcactccatcttgggcatcagagccagagcccttcttttaaaaaaagaaagaaaaacggcaatatacttcatttccatatatgcacttaacaacgtggaaggacaagccctcaaaattttcagggacttgcctgggcgaggtggctcacacatttaatccctggactttgggaggccaaggcgggcgaatcacagggtcaggagttcgagactagcctggccaacatggtgaaaccccgtctctactaaaaatacaaaaaaatagctgggtgtagtggcgggtgcctctaatcccagatactcgggaaactgaggcagaaaaatcgcttgaacccgggagggggaggttgcagcgagatgataacctgccaatgcactccagccctggtgacagagtgagattccgtctcaaacaacaaaaatttcagggctttcacattttcatctttctacagttctgtaaaataggatttgaaatggccgtgattatta

SEQ ID NO: 2399 - DNA, 1200 bp, artificial
  synthetic oligo
ggcacaagctgaatttggtccggttttgctttctgctataacaagggcagcactgagttcagtgtctctcaattgccagctatctttctctccaggacacagaaaagctctctgcactatgatgctgctgccagggtgtgcgggagtcatgtctgtgattcaacactgtttttcctaccaattcagtacgtctttctggataggaagttaattacaggtaatggaattaacccgatttttggtttttatgaagatgcttttttgtgtaggcagttgttaaattagagtccctgttgggggcaaattttgttggagtgttcatatatatattatatattatatatattatatatataatatattatatattatatatattatatatataatatattatatattatatatattatatatataatatatattatatatattatatatataatatattatatattatatatattatatatataatatataatatatatatgcgattgtaacttggctgagatattatctgattgtatttctgagttctgatttgtatttatctgatgatcaaggatgttgagccccttttcatgtatctgtttgccatttgtatcttttctttactctgataatagcttttttgttgttgctgtgcagaagttcttcagtttaattagatcccttttgtcagtttttggttttgttgcaattacttttgatgtttttgtcatgaaatctttgcccatgcctatatgctgaatgatattacctagattttctttaagggtttttatagttttgggtttcacattcaggtacttaatccttctttaggcctttgataaaattcaacatccctttatgttaagaactctcaataaactaggtattgaaagaatatatctcaatataataagagctctgtatgacagactgacagccaatattatactgaatggacaaaagcttgaagcatttcttttgaaaactagcacaagacaaggaaggggtccagtttcaattttttgcatatgactagccagttctcccagcaccatttactaaataggaaatcctttttccattgcttgtttggataaggtttgtaaaagatcagatggttttaggtatgtggtcttatttctgagttctcaactattctgttccattggcctgtgtgtctctttttgtaccagtatcatg

SEQ ID NO: 2400 - DNA, 1700 bp, artificial
  synthetic oligo
agcgactttatcccaaaccactaaagtcctctgactacattaaaacgattaacatcctagtttacaattagagaaatggagccaggcatcacaattcccaccaatcctctctctcaggcctgctcagcagccagggaagaatcagatttaggaccatgtacgaagattgcgtaccaacatatatacatacattttaagtggctattgttcttggactaagttaatgaaacctagaaagaaactttaaagttccctagttgatatttactaaggctatttagtgaaggaatgatctcatcactttcagtaaactgtagcctagactataagcctccaagaaaatcattagtcaactgtaattaaacaaacaaacaaacaaaaaagtcaaaatattcagagctgaagacattcagagctaagttaaaagcttcgaggaagaagaggagtgtgctcctgacttgggagccagcagaggagcctcctaagttagaagattctgaaggagagatggattaggaggcacaaagcagaaactgttagagggcaagagacagtagggccggggcgggcagcgggaccccagaccgtcagggcagcaacagcgaggcccagaggagaagatcttggagagatgacaaagaagcacaggaaagccgggttctggggtcctagaagaacccaggcgtccgacggagccagagggaccggcagaaagggatgcgaaggtgtaaggatgagggcgcgcaccagcacgcgggagaaaaagagggggcggcgggcaaaatgaagctgtttccctgctcctctgctcctctgcccctggtacagatcgcaactcctcgccgcgcaccgcgcagcgccgggtccgaaggcagggaagcggctgctggagcccctgtgacttcaggaccctgcctcaccttgctcgccgcgtcctggcgtcccgccgcttgtccgccgggtgctgcgctccgagggccaaagagggagtcgcgcggcgcagccggggctccctcctgctgcgaggcaccagcacccgcaccttcgcaccctctgctcgccccgaccacttcaccctgtcctggcgcaggcggagagcacggaccctaacccgaatgccgctgcagttattttcaaaagtccccgttccaggcttcccaggaataggagctgagctactgcggccgcagcggcagagcctccgcctgacctcaccagggtgtgggggggctgctgagggaggggggcgggaacccagttggggagggagggggcagtgggggggggagcgcgcgggcgggggaaacatggcggcgggggtggccccggcggcgcctgcgcgggaggcagggtggcggggagccggggctaggacggtgtgtggggtccgaacggaactcccaggctgtagcgaaagcgtgacagggccggaccctgaagctgaatgaccgctaagtggccctcacgcctcggaaaccgggaggctctggtgtgagcccacatggattctagtgccgggaggcagaaaaagtgaaaagtgtcaagtatccagggacaacagtgcagccgccccgggttagccactccaaggaggtccacccgtgcattctgccagccgtggcctcggcctcctcatagtcacggcggggcccgagcaaagggtgtgccctggaagcggtgccacctcacctcagtggggc

SEQ ID NO: 2401 - DNA, 1350 bp, artificial
  synthetic oligo
tgaaagatgaatgaaaagaaattatccaattgaacaagagaaagaaagagatttttttaaaacatatctgatttgtagtgtttgctgatttctatactgaaaatatttccaccatggcccatgtcaaggtaccaactacacattagtgaatgcatagtcaggaagaggtgcacacaactggctgttatccataaatattgctcactcctcaggcaaaaccagcagtactgtgggctattgagtctcaaccttctgaccacacacaccctgaggctgttgatatcctttttaggcattctcaactccctctgagccgtccctggtgttctcctcaacctgatttcaaatggataaaaacgtgcagaaggcatacagtaggattgccagggccatcccctccatctctagaggaagtctgtatgtgtaagacaacatttctccaacaaggaaatgagctaaatgacttcagctaaaaccaacagtatatttctcaaattaggagcctgatgtctgacacagataaaatgtggaaaacataacctagatgagcaagtacagggtgggcacacaccctatatatggaatggcaaagctgggcttataattgatcctcaggtctgtcttgtcattctggagctttgtaccaaaagccgctgtagcattccaaatacaaccccatgttaaaattactcagcaccctcaagaaaggctgaaaaacacggtaggctggaagtttcagtgacagggatgctattctgattaagagtcagttgtttgtcaacaagcaaagtttcagggtagggacggttctgaaattcttatacagggctccatgacatcaaagatccaaagatcataagcccctgcaatggcttatgagtattaaatcctcaaagccacaaatatcccagaaagttcctctccaacctaaccatctcacttgtacacaacacccaaaggtccagagtgaacgaacgactttctcaaggtcataaaactaatgagccataacaaaaaatgcagtcttctgattcccagtcccgtgtttttttcctgacatcacacttcctcttacacttccttccctgaacaagatttatctggctaatggtaatagagatgaaaaagtatttgtgtggtttagaggagaaacaaaaaaaactaatgggccagtcacagttgactctgatagcatcaaggaggaggtcaagctagtgatattgttgttgtgtaaggtagaaaatggaaacgcattctgaatcgaggaatttggatagtcccctctaagaagttagcaggaacactgttttgagaagtgctcagggtgcagctgcagtgttattacagagc

SEQ ID NO: 2402 - DNA, 3700 bp, artificial
  synthetic oligo
agagttggggcccagagcctacatttcttttcttttcctttttttttttttttttttttttttttttttttttttgagagggagtcttgttcccttgccaggctgaagtgcagcggtgcgatcttggttcactgcaacctccgcctcccaggttggagagattctctagcctcagcctcccaagtagctgggattacaggcacgcgccatcatgcccagctgatttttttttttttttttgtctttttagtagagacggggtttcaacatgttggccaggatggtctcgatctcttgacctcgtgagccgcccgcctcggcctcccaaagtgctgggatttcaggcgtgagccaccattcccggccagaagactgcatttctaacaagctcccccaaatgactctgatgtcttgcccccatacttgaatgggtattggttgagagccttgttctccagctctcctctctgttaaatggacatactgctacttctttcacagtaaaagaggagatgtgtgtgaaagcctgtttccgcaatgcacgtgctaatgctcttcccgccccttcccctcttccccgtcttttccctataccaaggtgaagaacttttattattcacttgattttggacccacttcgtgtttaatgcacctggcctaagatgcagagttgagcccagggagaagggacgggttgggggaggaagaaagagtcgcaaattcccaggcagattggctccatcggtctaatcaagctgcacttgacgctccgcgggcctgctgcgcccccgccccctcaggcgaaaactcgcctctgcccaaggctgtgcggggcgtccgcccccgcacttcgctgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagt

SEQ ID NO: 2403 - DNA, 1200 bp, artificial
  synthetic oligo
gtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgg

SEQ ID NO: 2404 - DNA, 2550 bp, artificial
  synthetic oligo
gtcctagagcttaagggccttgatattcattggatgcagagcatgtcaatctgatgttttcagcaaatgagcttagagctcactgagagcccctccttgacccttcctgtcccgccccctgtcacttaccaacccgaatctttcccgccttgtctaagtcctctcaggccaacctcagcgggaggctcctgggatcggctccctgcccttcccaccttagggtgtcctcagagacagacttttattccctcagtaaggagacagactcttattctctcagcagcccagcccctcacctcccctcagccacagccacatcagtggccaccgtcttcaccgttgtcacctcagcctagtcgccactccagttgaggcactgactggcgtcatgtctgccacaggggatcaagacctgatccaagaggaccaggaggctccagtgaaccaggagggagcgcaggccgaggccgtaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcgtggcggccgcctgatgcggaggcgccgcactgcggcgcccagtggctcagaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccgcagaggaggcctcagagaagcccacagaggaggccgcagaagagcccgcagaggaggcctcagagaagcccacagaggaggccgcagaggaggagctcgcagaggaggccgcagaggaaccggccaaagaggaaccggctgcagaggaggagtccgcagaggaaccggccacagaggaggctgctgcccctgagggtgaggaacaggctatctgcagtggcggggagacagggacccgtgcacccaagggttccaggcagggccgcggtgtgcgcacagctggtgaagcaggtggtgaagtgggggtcgggcctcgggtggtgaagtgggggtcagggccctcctgaaacttaaggccaaatgtgtaccaatgagtcgaagcccaattctctaacgacatctatgatttttgagaaaacatgccgccctctaccaacctgtgtttgatagaagatctgagatcatcaatgccatttggggggcccacagatgaatggccaggtagataggggttcaggagggagctcggcaggaaacaagggacaacggaaagaaaagaacaggcaaatggcaggcatccttttttgttcatggcttttcaaagtgtaaagattcttagaaagttgatccccaaatgatgaagtgatacaggggcccttggtaaaaatgaaacattcaggggggtgaggaaccaatgagcttcaccatagaatttgtcttttgaggcaacaaatattttcccagcaaagttctgatcaaaacacttagaatgagatcagacaccatgattctgatctcttctccaaagaactagaaataatcggcagctttgggtgggagatttactggaaaaaagggaaatagtgtcactgtggaaatgatcaagcagcagcaacgtgagggccatggcactgttgtgaaaaccagtaggaaggtgcccagctattcctttcttagttaagtctatcctcctgcttctcctgagggtggagtactgggtgccgctgctggttataaattgggctatattttctgtgaatgtctggtcccaacatctgtattattcttcgctaaagaagtcactaaatatcagcatgaaaagtgggatgaagaggcccaagatgctgcaggcaaggaagagaaagaagagaaagagaaggatgctgaaaacaaggtgaagaactccaaagggacctagacgcagcagaggggaagctgagaaaatccaggtatcggtgtatagctttgagaatcactcaactattcctggcatttacctgttgctgacagttttattttaaaataaaattcccagtaaattaattaagaaaaggttttagtttaaaaattcaatttagcttacttaaaatgttactagaatattcatgtacgtagtaatatgaactgcagtgtgttctgaaatacacttcatggctactcatttgttcatgttgaggtcttttgtcctctagctgcaggactactaacaagtggcaaatgtatc

SEQ ID NO: 2405 - DNA, 1250 bp, artificial
  synthetic oligo
ctatcacccaaggagaaagcatcaggggcccccagggacacagggaagatgtttcaaggggtgataggctgattggagaactggctgtgcagaaattttcttggagacccagaattttcacttccaccgcctcttttaggatcccttgcaaagcttagagcaacaaccaaataattgcggcatctatctaggctcataaaacctaaaggccaatctttaggtcaaatcatctgaatgtttccattagaattactttatttggttgagggaaatgacaattttctagttgctccaacaaaatgtttttgctttctcccttctaaagcacattgtccaaagttaaagattttgcaattttacagcagtgcaaatgttttcgatagttttaatagaggaaatgctgggtttctgggtgctggcagtgactacgtggaaggttaagcattcatggcatttatttcattcaaataattatgttttaatttgcatttctaaggctattttgcttaataaattcttattttgcttaataaattcttagtttgcttaatacttattttgcttaatacaagtggtcacagtaaaaagatcactacatagaattaatacagctattagcaattatcatttaaaacgctgatgcttggccgggcgcggtggctcacgcctgtaatcccagcttttgggaggctgaggcgggcggatcacgaggtcaggagatcaagaccatcctggccaacatggtgaaaccccgtctctactaaaaatacgaaaacaaaattagccgggcgtgatggcgggcgcctgtagtcccagctagtcgggagactgaggcgggagagtggcgtgaacccgggaggcggagcttgcagtgagcggagatcgcgccactgcactccaatctgggtaacagagcgagactctgtctcaaaaaaaaaaaaaaaaaaaaaaactaaataaaataaatgctgatgctccacacaagagctctttattgcgtgatttctgccatgtggctccatgctttggctttcttcctggccagtgagaaccagacaggctcaattggctcaactgggttctggaacttggctgggagagttgaagatcgtttggtttctttttccatggcaggaacttgcagtatcttctgagcttcaaatccaactggaaccacagcaaataacacacaagcaataaggaaccccagcgatattggggtatgttgtttatggaatgccatataatgt

SEQ ID NO: 2406 - DNA, 1100 bp, artificial
  synthetic oligo
agcccttgttcttgatcactgtgaactcgtgtctcctaattataagagccagaaaagggagagcccatactgaagcccaagttcaagacgtttaaaggcaacaaccagaacatatggtgtgcctgcttccttaagaagggctgagggacagtcaagcccgtgagcagtaagaaaaactgttttgaagtctcagtttcttaaatgactaaattcaatttgattcaacaacagcaagatgctaataatctgccattgtatctttttaactatttgtgctcaaataaagggaacagaaaatgtcttggagagtaatgtaggcatccacattcctaacacttcagataggacattaggtgaaaatctggcaggaaataaaattggctcagtgtcagtatttctgacataactgtatacctggatttcttctttaacaatctcctcgttgttctgaatgtcacttaatccattagaatcctgccccttcaagggaattgaccccactggccaatttcatgcttgccccagcttttatgtagcactgggtgtcaggacccttgacttaatgctatcaaccatccttccattggggttgtcattttggtacttaagggaaatttcccatgcaaaggtcaggttggttgttgataacttaggtcctattaataccctatgttgtcttcagccttgttttccagggtatcaactaagggatcaggccaaaagtgtgaggtataggcccaagccaaacatttaagaaagcttgcctttaggctattgtggccttccccaaccacttccttgtgagaagtaatgcccctagaatattttcctttaattttcacaaaaaataatttttttaaaaaaatggaatatctctgctatatgagtctctctgttgctgggacttagagaggaggggaaagaaggaggagtccaagaaaccagtttcctctttctgaatgtgagaaccctgttgccacttggtcatggtcatgaggctgcagggagtgtaactatggaggtgagtgaaagctagtgttgatgtttaaaactgaagattgaatacttcatggaagtgacttttcctgctgtagtacaag

SEQ ID NO: 2407 - DNA, 2150 bp, artificial
  synthetic oligo
tttagaaaattaagacaactcggaaaatttaaggtgattcttctctactcatccatgtttccctctctctttccatccctctctcggccttcctctcgtctctcttccacttcttggccccagtcccccatctcccttatctccctacaagatcatttattgtcagtcatgctagctgcttgctggctgcttactagtgccaaaacatcatgttctgatataattgaaccacattatttgacggaattattgctgtcagttatttgaatggtgttactaatcaatgaaatgagccttgtaaaatccaggtttgtgtggtgctttactttgagatgatgttggctaggtttcttgacacatagagaagctatagctttgtccagtctctctccctggtctgtctgttatataaacatcacccttgtgcagctctcccttctcagacttgagtcatttcttacaaactctgtcaaagtcaaggctgtaggagtgccacaaagtacccctgcaccaagtggtagggaatcgcggtgtgcagggcaggaagccccgggaataactaggtatttccaggtcagtcactgcagctgggccaagctcccccttggtgcttccctccttcttgcctttgtaagtcaaccaaagacaactgcaacagccttgggaatacgctcgacttccaatcctggcccctcggtccctggggcccaggtgagccaggtaggggtgccggccaggaaggagagaagcgtgaaaggcagagaagcctcgaggcgtccagccggccctcatttccccgcgtagagttgacctgtctctgtgtcccccgacctgccgagtcccagaagctgggttgaggactctcccgctgctgagctttcccactcacacgcacacgcacacctgcgcgagctctcccaggagggcaccgcccccaaccagcggggtgcacaggggaatgatgttgcaagttcgagcccagaggtgtctcgctgtcccccgcccacccccgggtcattcctcgccgcccgtttttgcggcgagagcaccatttgggcggttaggagcccctgcaaggccggctggcgttctgccaccctccactctgtggtgtctagggggagtaggtcggctgcgcccgccacttactctgaaatcttgaggcaagcatgaaagctagccatggtgctgctgagggagccgctggccggttacgtgccttgcctgctggggtgcatgggagcccgcgctgtgggcatgcccttagaggctgccacgtgggggcagctcggcacttcaagcgcccacccgcacgcagccccagacccacaggccgaagcaataaccagccagataaagtttcttctccaaggcctctcgctgtcttctgatctcagtccaaaaagggctgggcttgttccttacatggttaggaactgttaactccccttttccctctgtctccatcttcccgccacaacagcatccttagagcaaaataccagatgctctttcttagcctctctgtatccctgcagagctgagcgtgagaagtaatttggagatgaaaccctaaggaaagagtagaggcttttatccgagcaggaaaggacactcaagggctttgggaaggcgatgtaaataaatcgctttctggcattttagatggtgtgggatggagggagaggggagcagaggggagaagagagaggtcagggaagaaagaaaatttaagtagcaaggctgcaagcattcccatctagatgtgaacactgtttttgaggtgttctaagctgttcttgttcagtcttaaggaaaactatttactccctaagccagtctggggccatgaaccaaaaaagcaagaatttccttaaatttgtgaaatcttttctgccctcgagatgaaagtccctaccaaaggttgtgtgtacacggggaaccccaattataacatggcttacattacatggattcagagatgttgcagatcagattgtgtccacagaaaaccaaaagaactggagacagagacaacgagcaaaagtgtgacctaatgttgactgcctggaagacccagtagggcacctttcccaatctcagtcccataaagaggtgtgtgtccctaccttggcctctgagatgcacag

SEQ ID NO: 2408 - DNA, 1250 bp, artificial
  synthetic oligo
tcttcccatagtttgaattttctaactttagacaaatattactttgaaaaaacattccagcaggggttatctgggtggggagctaatggcttggtttttgttttgtttttttactctgtgtctctctttattggaaaaaaatgataaaacttttattatataaaatttcccccagttttataaaacaaaatgtgtgtgtgtgtgtgtgtgtgtgtgtgtgtgtgtgtgtatgttgcatgtctgcaagaatataagccaaactgctaatgtatgggcctgatttaagtactgtttggggaacttggagagggagaaaggagtttcattttttactttatacactcacgtattgtttaagtttgttatagtgaacatgtattatcattctacattttttttcagaaaataaataataaaccattttcccccctgaggttaaaagtgacacatgcccattgtggaaaatgtagaaaggtataaggaagaaactaacaatcacaacagttaacattttagcatatttctttccacgctttgttttatgaattttttgacatagttgagttcatactgtatatagttttgtatcctgtttttccctcaagattaaaacacaagcgttttgccatgtcatgatttttggtaaaagaatttaccaaaacagttttagttaaaagaaggtagatttattagataaagtaggaaaatatgttgtcagagagacaaagggcagcctgcaagagagaagccaactgccaggagacaaaggcttgctggaaattttataggatggcgtttatgctgtctgttgaagaggtctttgtgtaatattgataatgccaaggtcgcaatgagctaacttacaggtgtctggtgatagctgggcatgggaagattgtgaattatttgcgcaggaaggctgcatcttggtcatgaagaaagggagatttgtagcttatttgctttttctttttgctatttcatgctcccaccagcctgattccctttccctaattaggactccagaatgatgatatttgaatggccttttaatggttttgtcacaattcaagtgaattaattcgccattttatttgaagtcggacatttaggttgtttccagtttttctgtattaaaaatgaatctctgctgagcatcttagtaatgaaatatttgtctgcgtttctgtctccttgggatggattcctgaaaatggaattactaggtcaaagagcagatttctagaagt

SEQ ID NO: 2409 - DNA, 1800 bp, artificial
  synthetic oligo
ctttttggttaggcaggaaaaaaaaatgggttggaggcaagaggaggaggagggaagcgccaggggaggaagacagagaagtggcacgtgaaagggagaaaaggggcaaaccagaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctagg

SEQ ID NO: 2410 - DNA, 1200 bp, artificial
  synthetic oligo
cttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcaca

SEQ ID NO: 2411 - DNA, 1150 bp, artificial
  synthetic oligo
attctgttgatgttggagccctcccctttcagagtgcattgagtccttagtgtgtgccccctcgccccgatcaattcccaatccctgtgttgcagagagggcagcaccaccttctcagccgcacaggatattctcaggctgatgccaagagcaaatcactcccagccagcacacttctgccagccttggtaggcacagcgtgtagcagtgcgcatgtgggtggggacagaggtgacttttctcatagactgggagaaaaaaaaaggcatctgaacttcctggttacagaacatccggctagtagaaacctttgtgtgtttgtacgtgtcgggcagggggggattagtgaggttcccctcccctctagtgttagcaataatgaaggacactctttgtacaagacgtcaagatgagagcttccacacaggactccacactgtgcttctgtttcaccaggaagaaatcttgaatgtcagccaggcttgtactcatcaattcattcagccagtctctgagggctggtccttctactgagtgctggctagggtggggctgaggactgtgcccctggagagctgccagcctaggtgcaaacacagaaccttcattcatgcagtgacatcacagcagcccatcacaacactgccccaactgcatcagagcagttgcacctgataggtttcccaggggttacctgaggagcaaagccaagtgcgtgtggcccaaagtagacagcatatagggcctgcacgctgaggactgccccaaatgctggcccagctttttccaccagggagggtcagattccaaagccgacagccactcagcacgaggcccagacccaaattccactgccagccacttctactgctgaaaaggaaatagggccgaaaatgtagacttcaagggcaaacactggatcacccttgggagtagcttccagagctctgagtaacatcctggaggcagaagagaaatgtttgccctgccccccagcccacagtctccagcatcaccagcctttctggaaagccttccgaagtcaatttcagcccagccaggagcagggccaagttgacagagggctgagccagagctcccctgcactcacaccttgatctttctcttcctcttagacttgagtgcttgc

SEQ ID NO: 2412 - DNA, 1250 bp, artificial
  synthetic oligo
caggcaggagtgcagtggcataacctcagctcactgcaacctccacctcccgggttcaagcaattctcgttcctcagcctccctagtagctgggattacagacacacagcatcacgcccagctaattgttgtatttttagtagagacggggtttcactatgttggccaggctggaacttttggcctcaagtgatctgcttgccttggcctccaaaagtgctgggatcacaggtgtgagccacctcacccagcctttagccagcttttgacgcacaacgagtgggggtagcaaattcttgggcatgtccgcttacaaatgtggaacccaatgtttctatgtggggtggtggtggggaggtggctgctcctctagcaacagtgatccaggccagcccttggcaggacttcctcaccagagtcggctgcaaagccagccagctggcagccggccaggctcatagagtgaacccacttggagccgagagccccacagagggcacagcaggggcatgaggtccaacaaactcaggctgtgtgtgcttctgccccagagaatacaacggcactgggagagacagcagccacagcttcccgagaagcactggaatcctaggagcggctgccgggcaggggcaggcaaggcagacagatggaagagtgcccaggctgcatcatggtagcagtttgaggttctgttgaaggagggaagtgacaagctgggctgagtgacaggcatggatgagagggcagaccaggctctggagaaaacagcacatgaacccatctttagtgacagtgaactgagcagagaaatgtcactttcaggcctggaaatggccagggaggcataatagtgactcctgcagggggcttctcctcaaccgggagctgggcgtccagggcaaggtggccaggcttgtgccatctcaactacttgggaacaaatagacttggcactctatgtttagccaccaaagtcaagaccaggagccccgaagtcccatcccccaaggagctgaggagcccagatgctagaaagagggccacaggatgagcagggccagcagctgcctggcaggacatctgtcacagcccattgggcagcaaccaagaggagtgcggaggctacgcggccccatttgctgaaggggagggctgcagactgctcatctgggagagggacagatgaacccagagccagccaaggaggtcacagcccagtcagatcacaaaacaaaacaaaccaaacc

SEQ ID NO: 2413 - DNA, 2800 bp, artificial
  synthetic oligo
tgcctggggttaagcgatccccccacctcagcctcctgaatagcttgcacgacagcgcatgacaccatgcccaactattttgttttttatttttttagagatgggtttttttctattttgctcaggttggtctcaaactcctggtctcaagcgattctcccgccgaagccacaggaggagctagtatttacaggcgcgcacaaccgagcccagaatcgtacgggggcacgatttttaaatttttttgttttgaaatacagggtctcgctctgtcgcccaggctggagtgcagtggctggagtgcagtggcgttatcatagttcactataacccacatcctgcatcgtcctgaggcacacttcttaagggaaaaacatagaggtcccaatcggccctggctcttttttatttgacatttatcagtagggagcaaaaggtcagaatgatagttctagacaaagagtaggaaatgagaagcaggaggaggaggatgggtaacagaagtgggtgaggatggagggaagacgggagctaacccaagtccccagcgcctgcccagcacagtgaacactggcacttctgcagagggcttgcaacctaaggcgccagagcccagcatagcttagcagacattgcatgctccacagtcgcgtctagcgccaaaggaagggccacttgcagtgtaagccttctgggatgcactaaacaccaggcagggttctatgtgtactctgacgtggagtacctggagcttttgcaaggggcgtgttaggtttcttgcaacttgcacctgagcatccagagtgctctgcaaatcccagccccaaacttctgcttccacagatctcctggagagcgtggcgcactcaactttctggacattgctgcaaaaacctagcatgcagcctctgacttcatcatttcatcttaattacggtccgattcgcggactttgggtgggaacagaccagagctagagagactcatccattagttactaactacccagaggggagagcagtgctggcagtccaaattgcaaggtgcgctgccttcagcgtgcggcgtcttcgccctggagaagcattacgctggcccgcctgcctccagggccacacggaaacgtgttctgcaaactttctccaagggctcgggggctagattgtgtctcgctccgctgcctctccccctgcctcaatttcgactcctgccagacagctcagcccctccctctggcagtcaccccgcccggagtgggagtggtcaacgaagctgcaaaatggatcgcaagtccccacacacgtccgacccctccccgcgccctgaccacgaacgcatccctgacttaaccgccacactcgggccgtgagcgcctgccagcagggccttccgccacacacacacacacacacaccgcaagcagcggcgaccagggcaggagcccactccccgccacctgcaggcgtcggacccgaagtccacgagccggaactcagagcaggagccgaaggaccccagcgcagaatccgtggaggcgcacggcttcatccaccgcgctcccagatggggtcccagcccagatccggccacgaagacacaggcaaccccggcctgggtttcctgttccatgagctccaggaaggcgacagtcagtgcttgtctggggacccggaccggtgctttggggaactcccccggagggagagagtttggggaactctcccgagaagggaactttcccggagaggggggcgtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcggtaagcggcttgctctggagcttcccagttcccaggactctggggctcttccctggacgcctttggctctacccatgtctctttaccaggctccagtgccaagagctatttagggggctcaaggccactggctcagggccgctcttgagctgtgggatgcgggcgatagcaactgggcatcaaggtatttttcaagcagtatagatacgaatcaagttaaatatttgcattaaaattattaatcttcgggctggtgctgtggctcatgcctgtaatccgagcgctctgggagggcaagtcaggaggatcacttgagtccaggcgttcagggccaggctgaccaatatactgagacttcatctctacaaaaaattttgtaaaattagctgggcatattagcagcacgcacccgtaatccaaggtgctctggaggatcgcttgagcccagagttcaaggcttcagtgaactgtgatccggccactgccttccagcctgtgctacagagctagaccctgtctctaaaattagatacatagataaattacatgaatagatgacagatagatagagatagaaaaatcttga

SEQ ID NO: 2414 - DNA, 2050 bp, artificial
  synthetic oligo
accacaacaaaaaagaaactttagaaagcaaaacccccaatttttttgattactatagaatgcagaagctcctggactcttcccgagattgtgttcataacttttcagctgaaactaacatctgtgaagaccatctatcttgggtgaacctattttctggtaaccagtgttaaatattttttaataaataaaaattttaaacttgtattagaacagttaatttctcgtctttgccttttttccttttttaatatgtttttaaaatcccttttgagagatgagatctgaatatgttgcccagactggttttgaactcctgagctcaaacaatcctctcacctcggtttccagaagtgccgggattacaggcctgggcgatcacacctggcctggttgttgcctttgcaatatttgaagtacattttaaaatacatgcgttttgtgggattacttttaaaagaactctctgttttgaaatttagattgagtggaaactattatctaaagcattattttttactatttcctctgccccacgccttagttcttctggaactttgaagaactagagagacattaaaaatagtacatatgtcggtgagttgccgtggctccgttcaagcgatgccggggggtggattgcatgagcccaggagtttgagacaagcctgggcaacatggtgaaaccacagctccactaaaagtacaaaaatcagctgggcatggtggtgcatgcctgtagtcccagctacaggggaggctgaggtgggaggatcccttgagcctaggaagtggaagttgcagtgaggtgagaccgggccactgcactccagcctggacgacggagtgagaccctgagtcaaaaacaaaaacaaaacagacaaacaagtaaatacatgtctcttgaagactccatcacttatgggaaatggtattcactattcttttcctgagcatgaaaaaaatgttctgttagtgtgtgtcaaattgaatgttagtgtttactgcatgatttgtgtggagtatttctttggcttccaattgcaatatggcaaaaccatgtgctcaactgggacaaaggctagaagaggtcagaactcggtctgatggtgtcctgtggcttttatttctatagattctgtagttctgtttagagggtacctacagcattgaggaagctgatgtttaaaaagaacaggtgccaccttgggaaataagaaatgttggtttctggccaggtgtggtggctcacgcctgtaatcccagcactttgggaggctgaggcaggcggatcatgaggtcaggagatcgagaccatcctggctaacaaggtgaaatcccgtctctactaaaaatacaaaaaaaatagccgggcttggtggcgggcgcctgtagtcccagttacacgggaggctgaggcaggagaatggtgtgaacccgggaggcggagcctgcagtgagcccagatcgcaccactgcactcccgcctgggtgacagagtgagactccgactcaaaaaaaaaaaaaaaggaaatgttggtttcaaaattatctggtgaggatggcagtgggcatacacaggcgcattcctagatgttccccaattcagccaggcgctgggggctctgggtatcaataatctcctctctgtgcagaagtcccacattacatgcaactgctttgctgacatttcatatccacaactgtgaagttcgcagagtgagatagtggacaacatagcaaaaaatgcatgctttcctaagaaaacagagcctcgctttacactgggaacacatacgtgctgtgaaactggactttgatttaacccctgcgagaggaaattctgatggaactgtggcacttatcttagtaatcacttcatagtgcagccttggtgctcacaattaaccacttttaatagccaacgagaagtcttgcattgctagagattgctcataagcaaaggctgtattgagaagaacttaatgtttctttaaaaatgggcctggcttccttcaccctcccatttttgtttttgttgttttctact

SEQ ID NO: 2415 - DNA, 2450 bp, artificial
  synthetic oligo
aaccaaattgttaaaatgttcaataaaggcaagatccaaccgtgtaggactcactctcctcaccctgatgtccatcgcaattccaacaaaacatttccaaaacaggagtctggccaaagtttcctggcttgattcgtttctataatgcgtgaaaaaataccttaatgcccagtaggcatcgcccccaccccacagctcaagagtgacctactccagtggccttgagccccatatgtagcttttgactctggaggggagggagcgagactggggcagggccaaaggcgtcccgggaagagccctagcgtcctggataattgcgcacctctagagcaagccgcttacctagcaaacacgtcgggatactgagagcatcggaaaatgctgtctagctccttcaggtgcaacccactgaatgcactgggggagaagagatgctgctgatcttctggctgcagctccgaggaagaagagtcctgggcggactcctcaggctgctgctgccagggctcctggtatccaccgccgcccttctggttctcgtcgaacatggggtccgcagctcccgcgcagacgtgactttcttctgcttctgctccctgctcgggttcggactcttcttcttatcctctcctcccacttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactcgcggcctgagaaaggtggcacagcagcttcccgcccacgcgcctctctccgggaaagttcctttcctagagttgaacaaatcaccggtccgggtccccagccaggcactgaccgtcgccttcctggagctcatggaacacgaagcccaggcagaggtagccggtgtcttcgtggctagatctgggctgggacgcgatctgagagcgcggtggatgaagccctgcgcctccgcggattctgcgctggggtcctctagctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtcaggggcgagctcctggtcagggcgcggggagggggtcgggcgtgcagggaacccgcgctccagtttgcggcttggttgaccactcccaacccgggtggggtgactgccaggaggaaggggccaagctgcctggcgccaacagattggggcaggggaaggggcggaggagctagacccaatagagaaagttaacagaacatgtctctgtccagccctccaggcacgcgggcttgcagaatgcttctccagggcgaaggcgctgcaagctgaaggcagtgcaccttgcggcgtgggttcctggcaccacgctgccctctgactagttggtgactaatgcatgagactctctggttgtgttccgttcgcactcaaagtcctcgaatcggaccgtaattaagatgaaatgatgaggtcggaggctgcatgctaggtttttgcagcaacgtccagaaaattgagcacgcaacgctctccaagggggtctggggaaccctgagtttgggcctgggtttggcagaccgctccggatgctcaaatgcaagctgcaagaaacctaacacgccccttgctaactaattactccacctcagagtacaagcgtagaaccctgttcggtgtttagtgcatctaagaagggttacactgcaagtgaatcttcctttggctctagacgcgactgcggagcatgaaatgtctgctaagctatattctgctccagagcctcaggttgcaggccctctgcagaagcgggagtgtttcgtgtgctgggcgggcgctgtggacttggcttagttcccgccttcccttgctcgtcatcaccttctcttacccaccctcctcgtcctcctcctgctttccctttcctactctttgtctagaattatctttcagacctcttgctccctactgataaatgtcaaataaaaaagaggcagggtagattgggagctctatgtttctcccttcaagaagtgtgcctcagaacgatgaaggctgtgggttacagtgatctatggtcgccccactgcaatcctgccactgcactccagcctgggagaaaaagagagaccctgtaccttaaaaaagaaaatggttcctcgggatgatgctgggcccggtggtgcgtgcctgtaatcctagctactccaggaggctgaggcgggaggatcgctttagcccaggagtttgagaccagcctga

SEQ ID NO: 2416 - DNA, 2000 bp, artificial
  synthetic oligo
tccaaggtctgaggcaggtttcagagtggctactctgaccaattgctttcatcaggcttactggcttccacttcagcttcactcacatccatgcatattgccagttgctttctgggaaaaaaaaaccacaaaagttcattatttggaattgtggatgaaatgaaatacacctatgaacatttcataccggtttgaaattatctatcctcgcaaccgctccagcacatttttctgtgatacctagccccaggattgcattaggtaggaatggttgtcctttgtgtgcagacttttttttttttttttttttttggacagagtctggcactgtcaccctggctggagtgcagtggcacaatctcggctcactgcaacttccgcctcccgggttaaagtgattctcctgccacagcctcctgagtagctgggattataggcacccgccaccacgcccagctaatttttttgtatttttagtagagatggggtttcactatattggccaggctggtcttgaactcctgacctcatgatccgcctgcctcggcctccctaagtgtcgggattacaggcatgagccatcatgccccacctgtgtgcagaatttaagagagcactaaaacactcacgattcaagatatctctgtctatgtatctatctatgtgtctatcatctatctaatctatctatgtatctaattttagagatagggtctagctccgtggcacatagtggagggcagtggcatgatcacagttcactgaaacctcgaactcctgggctgaagcgatgcctcagagtagcttggactacaggtgcctgctaatacgcaccactaattttacaaaatattttgtggagatggagtctcactatattgctcaggctggttttgaacgcctggactcaagtgatcctcctgacttggagtcccagagcactgagattacaggcgtgagccacccaccagcccgaagattaataatttttaatgcaaatattttaaaaatcacgaccgatgaaaaaaaatccacaataaccaaattgtcaaaattttcaataaaggcaagatccaatcctgtaggactcactttcctcacgctgatgtcaatcgcgattccaataaaacatttacaaaaacaggagtctagccaaagtttcccagtttgattcgttgatacactgtgtgaaaaataccttaatgcccagtaggcatcgcccccgccccacagctcaagagcggccttgagccccatacttagccttgtggccttgggccttgtggccttgggacccctacatagccaggggccttgagccccctacataacttttgactttggaggagagggaaggcgactggggcagagccaaaggcggccctagaagagccctagcgtcctgggaactgggcacctccagagcaagctgcttaccaagcgaacatgtccggatattgagaaggtcagaaaatgctgtctagctccttcaggtgcaacccgccgaacgtgctggggctgaatagacgctcctgatcttggggttgcggatcctcagcggaggagtcctgggccaactcctcaggctgctgctgccagggctcctggtggccaccaccgcccttctggttctcgtggatcatggggtccgcagctcccgcgtacacgtgactttcttttcctgctcctgctccctgctcgggtttggtccgtattttcttctcatcgtctcctccagcttcagtcactgaagtctctatatccttcgcatctggaaaggaggaaagggaaagagaggtcggaggagagagctggagagagagagagagatcagggcgtttggcccagacacagggcagcctagacccgtggctgagagagacagcgcagtagcctcgggttcacgctcctctctccgggaaagttgctttccaagagttcaccaaatcaccggttcgggtccccagacaggcactgaccgtcttctttctggagctcat

SEQ ID NO: 2417 - DNA, 1750 bp, artificial
  synthetic oligo
agagctgggatttgaacccatcctctgagtactgtccctgacacagacgacgtgctcaataacctttgctattatgctataattagtgttcttttgtaattagtaaactagagataaacagaaatatatgtatcatttagctcaaaatttccttcacttgtttgaatatcgaattagtgccatacatatctagtggtacctctactctgttaattacttcttttactgtgcagaagctttttagtttaataaatgccatttgcatatttttttgcctgaaatgcacagtcttatttactatatccttattctttgttggaatgttgccttagaactatagaaaagtagtgatacattaaaaaaaaaacataactaagtgtctagggataagtggagataactggaatgactagcataagccagaaagccaaaaagcattctttccaactctgacatcatatttcttgttggcctaatgtgttaatgctatacataagtcatgatacctagggaaaaagtaaactacagacagcttgcgataagtggtataattagttgaatccaataagatgaaaaacatattctcaagtctaccttctaatttcttctggaaataaggagttaataatacagatatctgggagtacctaaagaactagttaagtagacacaagtaaagttaaatagagaactacatagtagctcattatataaaacccattttccccaaatctaaaccctaaccactcctaaccccttagtatttgcagagtatattaaaaaacacagatatattgaaaaacacagcaggcaagggtctctgcctttgcttcaggctctcagagagatgagagttattattcctggcagattgtagcaacaaccatccaggtgtatgtaaagaacattcttgcaaatgtgtgtaatctcctctgatctaacatcctatgggtaggtggagatgaggcaagaggaaaagactacagtagcaaatcatttcatttggatacttaataaattaagtaaactactaaattatttgaccagcttgcatttgtaattatatgccaaaaagtatgcttttttattttatattgaaatcatatttttttctttggagaagaatggaattggtggtgaagtgtcacaaagtctgaaatttacctgtgaacgtttcagcaaaaagcaaagaagcaaaagcacatgcacacatagctatagaaagaaaatatagcaaaatgttaacaaagtttgaacctacttggtgagtataccagtgttactgttcattctttaaagttttctgtatgtttgaaaattttcattaacaatttttaaaaaataaatggaaggtttcaacaaagtacataaacccaaaagccttacacttaacatctaaggctcaaatagcaacgaagtttgacttctacaataaacaataaagacccttggcttttatttcactaaagtattgccacattataagcattgccttaaaacgtctgctctcaaaaagacatttggggttatatggcaaaagtgtcaaagcaaggcactgaaagaccaaagaactccatgtaaagattatcctaaaccgaattgccttgggatttctaaaagtactgcaaacactacccaaggctgattttgtccacgtctagcgatttccccacctccgtccttggatgccggcattccaagtggctcacaatatctcccagccaaacacactgaaattcttagacttaag

SEQ ID NO: 2418 - DNA, 1850 bp, artificial
  synthetic oligo
agctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcggttgcctctctcggtccttccgagagctgagagacactgcctctggttgcgagctgcagcccaagtgccgcctccccctcccttccactcttctccctccctcctcttctgcctccctctgctctgggaggcagcagcattggcggtccgtgcagccgcgtgcgcttgcgcaagaccccccccctcctccctccccctcagtctccccatcctagttatccacctcccagccttccaagccagacaggga

SEQ ID NO: 2419 - DNA, 1250 bp, artificial
  synthetic oligo
ctgtctcctccttttcccttccccaccctgtgttagtgttctttttgaaaagcagagccattttattcatctttgctaaagatgaatacaatttgaaataagcaggccaaaacctcactttgccttgattggaggcaagtccagtggaaattcatcaaaagtttgaattatagactatgtggaaagaaatgctgttttcatcacttcaaatacctataattattggaaccaagctgctaggactcttcagggcacccactttaatgaatagcaaagaatgatttgtacttaggacatcaactgttgcccagaggactctcaagcaattttccctctgcaatacttttaactccactcccctgtattcttgttcatggccatcatttgctgagcaagcccttccatcggagatgctgtaaaggtaaactgcaattagacccctgacacaatcctcactgactccaaattggtgaaatctgaataagcaaggacatactgaatctgaggaattttttaaagagctatttcgtggttgggtttgttctggttcatgagtccaagcagggaggaagagcttgttggcaagcactgaccactctcatctgtgattgctctgcaggcctgatcttactcatttacttcttcttctatgcctccttggctgctgtgatcaccctctgcatgtacacactatttctgaccatcagtccctatataccaaccttcacggagcgggtaaagcctcctggtgagtgtgcccagatgccctgtgttgtcagaacttgctggacagaaatatgcttgcacagcatgttcagcctcaattaactttggctcttcctggtaatgacttagagattcaattattaggaggaaaagtaaaatggtacttggcaaattatggttcttttcattttgattgcctggggggaaatggtttcatgggaatcaatacaaaaaaattatcccaagaatgggttaatatatccaagacctgttttcattgccaggagttatgatcagacccttcgcccatagccttaacttcaacttcaacgtttctgaacccgacacttggcagcattatgtgattagcctaaatggctttctccagggtaagtaagttcgtctgaatagtggaaagctcttttgaaaggtgatgggtgggaatccaaaattcaaaattcacctggcccaggaatcccagtcttactaaccccaactcatcatggtctgtccttactttgcat

SEQ ID NO: 2420 - DNA, 1050 bp, artificial
  synthetic oligo
gtgacagagcaagactctgtctcaaaataaaataaaataaaataaaataaatgttaagtctccaccccaaagtgaaaattggtcatatatgcatgtttgttcaatatgcatgcatcaagaccaccttcatgaatattcatagctcctcctgtaacctgttgaatacatatactttgccaacctctttttttttttttttttttgagaccgagtctcgctctatcacccaggctggagtgcagtgacgcgatctcggctcactgcaggctccgccccccggggttcatgccattctcctgcctcagcctcccgagtatagctgggactacaggcgcccgccaccatgccctgctaattttttgtatttttagtagagatgaggcttcaccgtgttagccaggatggtctcgatctcctgaccttgtgatccgcctgcctcggcctcccaaagtgctgggattacaggcgtgatactttgtcaacctctttagcataaagctcctaccccaacccttcctccttccaagtactacctgtctctggtcttggctggaggctgtgttttccagcctgtgggatggccattttgcaggctgtaactttttataagaaataaagtctcctctccttctctaaatgtataaattgtgtgttttctaaagataacagtaagttcagtaacaaagtttaacgctgaatataaaatgacttgggtttttttcagggataataggaacactaattttaacagagaaagaatgtgttaaaaataatgttcttaattaagaaacttatggagcaaaaatatccttgggattggttatagtgcacatgtaattgataattgcatccatgcatccaaacaagctgtaacactatatctatcaaatagatagatattctatttgctatgctcatgcacatgcaatcccagcaatttgggaggctgagacaggaggattgcttgagcctaagagttcgagacgaggctgagcatatagtgagacccccatcactacagaaaattaaaaaattagctgggcatagtgg

SEQ ID NO: 2421 - DNA, 1250 bp, artificial
  synthetic oligo
gggaccagacattcacagaaaatatagcccaatttataactagcagcggcattcagttactccaccctcaggagaagcaggatagagttaagtaagaaaggaatagctgggcaccttcctactggttttcacaacagttccatggccctcacgttgctgctgcttgatcatttccacagggacactgtatttcccttttttccagtaaatctcccacccaaagcggctgattatttctagttctttggagaagaagagatctgaatcatcgggtctgatctcattctatggtgttttggtcagaactttgttgggaaaatatttgtttacctcaaaagacaaattctatggtgaagctcattggttcctcaccccctgaatgtttcatttttaccaagtgctcctgtatcacttcatcatttgggggatcaactttctacgaatctttacactttgaaaagccatgaaccaaaaagcacgcctgcctcccatttgcctgttcttttccttctgtttcctgcggagctccctcctgaacccctatctacctggccattcatctgcaggctcgcaaatggcatcgatgatctcagatctcctatcaaatataggttggtagagggcggcaagttttctcaaaaccatagatgtcattagagaattgggcttcgactcactgggacacattcagccttaagtttcaggagggccccaacacctgcttcaccacccgaggccccgaccccccttcaccacccgcttcaccagctgtgcccgcaccgcagccctgcccagagcccttggacacatggatccccgcttccccgctgctgccgctagcccccttaccctcgggggccacggcctcctctgaggtcggttcctctgcggccggttcctctgtggcctcctctgtgagcttctcctctgcggcctcctctgggggtttctcatctgcggcctcctccgcgggctccctggccatctcggccaggtcagctggcactgcaggctctgggaccgacgcggcctcctggaccgacgcagcctcctggatcaggccgaggccctcgccttctggggctgcagcccctgcacccagcctctgggacagcagcagcaggggagggttgtcccagaggttgggcacagcagcgtggggccccaccatcaggcggctgaggtgacggttcgctatctggatgtggtcgttgtgatagaggcggcggagaagggagtggaccaggtac

SEQ ID NO: 2422 - DNA, 1350 bp, artificial
  synthetic oligo
ttttctttttggggatcttcttaatgtttacctttagctccttaatccatagtgtgagattaaagtctcagatgatttttattttgaacagctcacctataccaccacttattgagtaactcttcccctgtgtactgatgtgtggccatgtacgctttagcactttctgtaaaggtagaaaacatgcaagagaaaactcattttccccaaatttcagagcttggtacggcctttagctattgagtccaagcttattcttttttaagtggaaaaattaaggcctggagtagttaactggctttccaatgtcatactactcaatggaggagccaggagtagaaccaacatcctctgacctttaatccgaaattgagacaggcatgcttattgtacatacagcttcaggtgcaatttgacagcacaaggttaattacccaaataaataaatggctatgagttgagggtctctgaaattcaggcaagcctgtcctcctgactctgaatcaatcagcaaatatttactaaacacctacattcaatgccttgtgtaaaaccttgctagggacagagaagcaggtgccaccacctctggcaagaagaatctcacagtctagtcgggagaaaggattgtgtattgagaatggaggtaaaaaagcagcacctgacgcccgggcgcggtggctcacgcctgtaatcccagcactttgggaggccgatgcgggcagatcacctgagctcgagagttcgagaccagcctgatcaacatggtgaaacccaatctctactaaaaataaaataaaaattagctgggcgttttggcacgtgcctgtaatcccagctacttgggaggctgaggcaagagaatcgcttgaacctaggaggcagaggttgcagtgagccgagatcacaccactgcactccagactgggtgacaagagcgaaactccatctcaaaaaaaaaaaaaaatgcagcacctgacattcagagctgacctggcactcacagctaagccatcttattctcctactggatataaacaattgcatagaacaccaacatcagacaggatcactctatgtccatgataaaaagagacaaagcaaggccactttataattttattcaagcagagaaaaatgaagtcacaaaatactaaacaaaatactaaacttagcttctcttgattaaaatgagtaccacttatttaccaattacagctttatcctggttctaatagcccctctctataaataagatttatcgaaataccaatcagaactgcacccactttctgatagcacctaatctagagcaaatccccactttgttcaaaacttccacatattcta

SEQ ID NO: 2423 - DNA, 1050 bp, artificial
  synthetic oligo
actgggtaattataaagaaaaagggtttaattgactcacagttctgtatggctggggagtcctcaggaaaattacaatcatgggagaagtctaacgggaaacaaggcacgtcttacatggtggtaggatagagagagcatgcaggggaaactgccacttttaaactaccacatcttataaaaactccctcactatcatgacagcagcatggaggaaaccacccccataatgcagtcacctcccaccaggtcggtccctccctccacatgtggaaattactatttgagatgagatttgggtagggacacagagtcaaatcatatcagtgaatatagcagaatgcttcaggctgggtaatttataaaggaaacagatttgtttggctcacaattctggtgccagggaagtccaataggatggcattggcagctgctcagtttctagtgagggccttgtgctaaattacaacatggtggagaagtagaagcatgcatgccaaaaagaccaaacataagaggcaaccttgctttataacaatgtgctccctggggaaataaatcaattcccgcaagaactaacactgtcttctgtgaaagagaatctatcttaacaacctaatcagttcttaaaggcaccaccccctcattaacatcatattgggaaccaagctttaacatgagttttggtaggaggaaaacatattcaaaccataacactgcttgtataaacaatcctgctctcttgaaatcactgctgatgaaagtttggtctataactttttagaatgttcttctaggcttatagaaataacctgtcatgagtcatgtgatatagtttaggtatgttcacatgctgaaatgtaatccacagtgttggaagcagggcctggtgggacgtatttgggtcatggtggcagatctattatgaataaatatatgttttttctgtaaagactggggggcttatgagagtaagagttatattttgtttatttgtttattagaaggtcaaatatcactgtgtttacatctccagttaaagtctattaca

SEQ ID NO: 2424 - DNA, 1000 bp, artificial
  synthetic oligo
ctcaatcaattttcagtcttgaaccagtttacagacccaaaaccccttgaatgaaggggaggccaggtccctttcaggaaggaccccactatactatcaacaatttgtgctgttaatctttctctcatccttcctcaaagagacctctggccttttaccagggtaactatacattgaggaatgggaaatgatcagacattttcgggactactggacactggctttgagctgatattgattccacgggacccaaaacgtcattgtggtcctccagttgaagtaaggtcaggtaattaataaagttttagttcaggtccaacttatagtgggtccagtgtgtccccggacttatcctatgttcatttctccagtgccacaatgcatagttggcatagacatactgagcaacaggcagaatccggactttggctccctgactggtagggtgaggtctattatggtgggaaagaccaaatggaagccattaaagctgcctctacgtagaaaaatagcaaatcaaaaaaaatcacaaacattaaaaaattaaaaataaattacatcgcgatttatttaaccaaggaagtgaaagatgcatatacagaaaactaaaaaagagagattagtgccaccattaaggacttgagaaatgcaggggtggtgattctcatcacatcctcattcaactttccctttggcctgtgcagaagatggatggatcttggactatgacagtggattatcgtaagcttaaccaagtggtgactccagttacagctggtgtactagatgtggtttcactgcttgagcaaattaacacatggctcgtatgtgttatggctgcatatctcttggtacctgatatgcagccattgatttggcaaacgtctttctccattcttgtccataaggcccaccagaagcaatttgccttcagctggcaaggccagtaatatacctttactgctgtacctcaggggtatatcaactctctggctttggt

SEQ ID NO: 2425 - DNA, 1050 bp, artificial
  synthetic oligo
tcaatgtaaagctcttaatgcaaaattgaaagcaatgcatggtagctaatactatcatttgtcaatgcaataagaatattttattatcataatatgctttacatgatattttcatctttgttgttgttgtattagctatgatacagtctgttttcttttttggctttttgagaattggagctcctactgagaagttttcgagctttcacagatcttttcactttctggatcctagttcctgtgagtgtttccaaaggcaaaatggcatttcagaagcaatgataagtgtatttctaaaatagaacacataccacgcagtttcttaggacagaacaatatcctggtgagaacagctgggctggttagggaaacaaatggtcaaatgcaattctcgaggatgctctgtaaggctgagggcaataacaaccacatgagctttgttccttgatattttcttttagtttcccaaagtgctttgcccctttttcctgtaagtgtaatctctgtacctaagagtgaagtgaagacaatttcttgccaggattatgagcaatactttaatgattagtcagcagcactaactacttatactgtttggggagcatctaagagcatcttgaagaggtcccagagaggagacattctctcttagagctaacgcctttgttcttttgtgaactcactatgctttatttctctgtcagctttaaacgcatgtgttgatcagcaaaaggatacccattacaaagctaattactattattggcctatatgtatcattcaggtcatcttcccagtctctctgcttcttagtagttggggcaagtagccaataattgagaaaaatatttcactttcaattgggtccactctggaactgggtacacagcaattcctgggaatgtgaaatgctgagtttggaacctggagtgggtgctttatatatgtatgcagtagtggcaggaggtcttgcttcaagtgcttatcttctctctccaattgtaacataggtctcttatgggtagaaaccatgagtgtgttttattgttt

SEQ ID NO: 2426 - DNA, 1250 bp, artificial
  synthetic oligo
tacataatttgacaacttggagaagccatcggctgagataatcttaaaattccactggcccagctcactgcagccttggacacatatattggcaatggctgtttataatatgcagtgagcagccggttatcatggccttaccatcattaattcaccctccaaatttagagtgacaccattatggtaagcattaataattttaagcataatagttgtgataacagcaggtagttttgaaaactattacccatgtttcaataacacatcctgaatgttaagcttaaagcagtctcctgagtagaagaggaaatggaaatattccgataataacagtttatagtaataatagtttagagctctagcttgaactggcttgtgtatgtcctttattttttgcatctctaggtaacatcgctacggaatttcatttttcaaaagtactggaatgagctgatctcatttgataatgctgcagttatagaatggctacagttcaagcagcttctaaaaattatagggccccagaaatgtcagggccccaaagttcaaaagtaaaatatataacaatctcttatctgttaaaagggtctgctctgtataaatggatcatttaggatggacaatttagaaaaaatactgaggtgtagtagataaaaacaacacatttgagtccaccaaacctgggttttaaaccctggcttggccacttccctttggcaaattactttacattccttctcctaagctttttgtgaggtggagagagtaatgcccatctcattttgttcagatgattatgtgacataatatgtataaaacacctgacacacaggaaatacttaatacatagtactattatcctcattttgaattggtatatagcataagtccagggttgtgaattcgatctccatataggccagttcacatattcatggatgttttcaacaaattcctttgccttgacccaggccctgggaagccagtcctaagagtctctgcctgtttggagctcacagtgtagagggcatcagtgagagacatctcctacaaggtgtgataaatgctacgatagaggtagacacagtagaagagaaggcttcagttaccatattgtatgtggaagagaaggtgtcacagtagaagagaagtctacacaatagaagagagggctcagagaaggcttctggaaggaggtgggatctgagtttaaacttgaaagaagagtagctaataccaggatggagaaa

SEQ ID NO: 2427 - DNA, 3650 bp, artificial
  synthetic oligo
cggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaa

SEQ ID NO: 2428 - DNA, 1150 bp, artificial
  synthetic oligo
ttttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcattttta

SEQ ID NO: 2429 - DNA, 1100 bp, artificial
  synthetic oligo
gttgatgtttttgtctctcaacattttgaatatttcacttcattctgttcttgcttgcatactgtattagtcctttctcacattgctattaagaaatacctctgactcagaaatttataaaggaaagaggtttaattgactcacagttttgcattgttggggaggcctcaggaaacttacaatcatggtgtagggcaaaggagaagcaggcacctttctcatagggcaggaggaaagagtaagtgcaagcaggggaaatgccagatgcttataaaaccatcagatttcatgaaaactcactcattatcataagaactgcatgggggtaaccactcctatgatctaaatgcctctgcctggccctgcccttgacacgtggggattatggagtttacaatcaaaggtgagacttggatggggacaaagagccaaaccatatattccaaccctggcccctcccaaatctcatgttttccacatttcaaaaccaagtatgcctttccaatagtccctcaaagtcttaattatttcagcattaactcaaaagtccacagtccaaagtctcatccaagataagtcaagtcctctgaaatctaagcagaggttcccaaacctcaattcttgacttctgtgcacccgcaggcccaaccgcttatgtaagtcaccaaggcttgggccttgcatgctctgaagcaatggcttgagctgcattttagccccctttagccaaagctgggatgcaggacaccaagtgttgagactgcacaaagtagcaaggctctggaacgggcctatgaaatcattttttcatcctaggcctcaggacctgtgatgggaggggctgccatgaagacctctgacatgccctggagacattttccccattatcttagagattaacatttggctctcattacttacgcagatatctgaagctggcttgaatttctcctcagtaaatgggttttacttttctatcacatcatcaggctgcaaattttccaaatttttatgctctgcttccctttaaaacattaagttccaattccaaacaatgtctttgtgaatgcataaaactaaatacttttaagagcacccaa

SEQ ID NO: 2430 - DNA, 1550 bp, artificial
  synthetic oligo
cctgtgaataatgtaagtcaactgccttccctagccacccctatcattgtcaaatgagctcattaacaaaatggtcaactctccacagctgcgtgtgcacagtctgccactagtagagaccaacatccagcccccaatatggaaccattctctggagtaatcagctagctagtggcaggctaactacactggactgcttccatcatggaaagggcaatgttttgtcctcactggaacagacacttatttttgggtatggatttgtcttacctaaactcaatgcttctgccaaaactactatatgtgtatgcacaaaatgccttatccaccatcatggtattctacacaatattgtttctgataaaagaactcaattagtagccaaagacacacagcaattagcccatgctcatggaatttactggtgtcactatggttcccaccatcctgaagcagtcggcttgatagaactgtggaacatctttctgaagatacagttacagtaccagctaggtggcaatatcttgcaaggctgggataaggtacgccagaaggctgcatatgttctgaatcagcattcaatataaggtactgtttgtcccatagccaggattcacagaaccaagagtcaagggatggaagcgggagtggcactactcaccattatgcgtagtgacctataaagttttggttttctattaccacaactttatgctctgatgtcctagagattttagttttataagaagaatgtgtctaccaaaatatacagcaatgattccactgaactggaagttaagactgccacctggtcactttgggctactcattcctccaaggcaacaggctaaaaagggagttatggtgttggctggagtgattgattcagagaaccaaggagaaattggactactacgacacaatggagataatgaagaatgtgtctgaaatacaagattcttgagggtgtcttttaatattatcatgccatatgattaagatcaatggaaaattacaacattttaattcaggcaagactatgaatgacccagtcccttcaggaattaaggcttgggtcaccataccagggaaagaatcataattataaccagatgcggtgcttgctgtaagcaaagggaatacagactgggtagtagaagaaggtagttataaatagcaaatatgaccacatgaccagttacagaaaggaggactgtaattcccatgagtatttcctattttgttaagattacatttttgggggcatatatacatatattaggcaaatatatttgttttctctcattcttttattatgtaacaagatgtattgagtttatattagtatttaattattactaatgttatatcatagtatttagtttatgggatttcagaagaagagaaaacatcactgaaggactttatctcttctgagaaaagaatgaatgtgttttaagttctaaacaagatagttatatcatcttttgtggagctatgaccttattatcatctctatttggaaattaaatatggttaacggagatgtg

SEQ ID NO: 2431 - DNA, 1000 bp, artificial
  synthetic oligo
atagctattttcatacatacaggtaggtgactaacaagtatctagatagaaataaggagaaattatgtcacacatgctatatttaattttatgtgaattaatttagcacaaagaatcactttgcaggagtaaatctgaaggtattgctaaacttcaaataaatgtttattcagagtgagagacatccatttagacagaatttacctgcattgtttgttaaaaagaatatggaaaaaattctaaaaggtgtagtttctccttgttgctcatgtataaaaatatacttgaggttttaaattttgatctataactagcaatatgtctaattataaatttgtttaagttttttggagttttttaatattaaagatgatataagaagatttaattatttaatccttaagccatttatttatatttgtcttactttactgcactcactaagaccatccttataatgttgaaatgtagttctcatggcgggccaatcttttcttgctccagattttaaaggaatagaactttccccttttgtggcagaggcaatgctatgtatttatcacatcacaaatcttttctgttttaccgtgtacacagaaaactatattttcaatcactttttgcagttaggttgaggatatgtaactagattcaggccatgaagtatgggcatattcaatgtaaaactctccaagatctagccattagaatgatctcttggcctttaagtgatctccacttgcttttcccttttttgtgatactggtgtctgtaaacttcagatgttaaggctatgggatggaagcagcttctatctctgaggtactacattgaaaaggtgctgtcctgaagaactgtcagacctgaattagaattcacctaaaagtgaaataatgtataaatccacaataatttggtactcatctattgttgaagtaaatcttttcctctttgaacagctaaattctatcatctacaaatcaaatctgaacaatacact

SEQ ID NO: 2432 - DNA, 1450 bp, artificial
  synthetic oligo
tatatatatatatatcttagtggagtagaacagcaatgattaatgccatggctcaagatagaaaaatataaaaatagtgatacccaacatatacctatttaatttgacagtctagactatataaaaataaattggtttcagaggatggcagtggaccaccacaaacaaaaccaagtagtaatcccaaatgcaatgaatgtgtctggtatatattttttaacagattaatatgttctcacatatgtggtatgcaaacattcatttggataatgtggtcttttccatgggtgttagaagcaattttcattcacatggaacagaaaacagcatttatttatgggtgtgtcacagggctatgttatgtctctcacctttgtcatactattgtaataaggggtctacactgtctgcacattttgcagtaaatcacatttatttactatacttattatattgataagtcatgttaatcaaaacaaatgtacaagaagtggcatctatgttgtagaccataagacacataagctcctaggaaataaaccatcaacagattgaggggcctaaaacatcagtgaggtttttagatattcactggtctgggcatgccaacggatcttctccaaagtaagaaacaaattattgcatctggcaacactcaccataaaaaagacaatacatggcagtcctcttttggttctggaggcagcatacttcacacatctggatactgaactaacccatttaccaagtaacatacaaaactgaaagctttaagtaaaacaagattgggaaaaaattctgcgttacgtccacggctgcagtacaagatgttctgccacatgtttcatatgacacaacagacgctactgagatatctggtaggaaaccatgacatgtagagtttgcggaaaactctaattgaaaataataatggaaaacctttacagttctgtagcaagaccatgccatcactagtggagattatgcaccactcaaaaaactgcttctggaatgcagtcaggctttgttagagcacctgatcatgaagcattaattgaccatgctgccagaactgctcaacaggatctcacttcttttgaattcatcaagtcctaaggtcaagaggatccactagcaatcaattgtaagattaaattggtacatccagaattatacatgagaaaggccagagggcacaaataaactgcataatcttgtaccccaagtatgagaccactgttataccagcacctttctttagctcatagctatggccacattggtagtgactcccttataacaaactgatggcggtagtgaaaagctaagctcagttcatgaatggagagtgttgtggaatgaatgtttgtgtccccatcaaatgtatatgttgaaatcctaatccccaatttgatggtattagggagttgagcttttgggaggtgactag

SEQ ID NO: 2433 - DNA, 1150 bp, artificial
  synthetic oligo
atttgtcaaaaaataatttgttttaagcaattttggcatatttattgatttcctctctgtcttatccactgaaaagatctttttacaattataagcctagaccagcacacagtgcctggtatataataagagcttaaagaatgttgaatgagtaaaaataaatttttccaatgaaatacacctcagatgggtagaaatatgcattaatatacaaaaggttagagtaggtggcctaagaaagcctgtatttcaggagaattacaggcatgtaaagtgcataaaacgtatttctaaaattcctacaggttatcaaaggccagggctgggacaatagtgtgacaagcaaggcacttcccttggacacaaaatatcaggggcagcaaaagactcagaattaagatgactagcattttaaaacaatattttttaaaatcaaaattaatgtaaaaatacatagtgaacagaatataaaaaatttaaataaaaatagtaacaatgtagtgcctagccatattagagcctgtggcaaaataaaaaaataggaaaattgattattatctatagtgtctcctgacttctaaagatgatggatcccaaacaaaaggtaaaactaggttgcgacatgagaatgtaaattgtacaagcccagagaaaagtaaaattgctctctataagaaagggggcagacgtggaatagaatctaggagagggcaggagggcagagaagctggagagacagaaatattagaggaaagaggaagggaaaaaacaggggaaaatcagataggaagaagactttgggtgagatatgtccaataagggaatcagattaaatttccctctgttatgcacaatgtaacccagtcttccatttccccatgaaatattcagcaaaatgcacatttcccttcaatgctttgggaagtggatttatttggggggatgaatgacagagttctgtgttttgtctcaggaagggcaaagggcaggagcagagactatgcaaggagtttcaaggaggatacagtctgttccttcttcatttaatcagtcaccaagttctagcaatgctaccacttaaatatttcttgattctgtctacttccttatgtctctactgctaccatcaccttacctcctaactaattta

SEQ ID NO: 2434 - DNA, 1050 bp, artificial
  synthetic oligo
ctcccctgccccaggttctggcaggcagctgtgcgccccccctcagggcccacgtcacaagtcctcagaggggctgtcaactccccattgttctcggggcttctggggcttctccggcattcctttggctcatgaggggaaatgcctgaagcttcgtcttcacctcttcagatgcttgacctaatagtcacccggccctcctggcccctcaagggatgctgtggtgcgtgggagaatctggctaggctagcactacaagtacacttacctcaggtcaaagatgaaatctgagggggtacctaggcctctgtgtcttgaactcaccttgaaggccccagccaagtatttccccctctccctcctgagtattgcacacagctacccgcagagttacataaacacagccatactcctccattccaaattctacccattccacacagttctgtacatgctctcacatgcacactcccacccaacccatctttccaggggagccatcaggtgtgtcagggccagaagctacttttgctgtgggtacaggactgacattcttccaggaagcctcccctgactgacaggcaaaacttcctgggtagaagctgaccccagtccccatctactatttaaaatatggtgggtagggaaggttttactggagaaggtgatgtttaaagcaaatactaaaggatgtgaaggagtaaacaatgctgatattcaaaagaaggacattcagggccaagggagaaacaaatgcaaaggccctgaggtaggaatgtgcctagtgtgaataaagaataacaaggaggccagtgtggggtggagggctcgaaggaggaggagtaggaggtgaggctggggaagtgatggagaccagatcctgtggggcctcatttgcctttgtaataagagagatgggagggagttaccagagggttctgagcacaggtctgatatgatctgacttagattgtaagtgattattccagatgttgtgttgagaatagactgtagggggacaagggtggaaacagggagattggttgcaat

SEQ ID NO: 2435 - DNA, 1800 bp, artificial
  synthetic oligo
gagacataaccgccgggggtgggcacttgggggccccttcagtcctaaggagacaaaaatgacaagagagaagtcatggacatatcctaggccaaaggaactccccaggaaaggagaggagagaggagaccgccttctctttcccccaaactccactcagcccaaacctcaatcccaaggcccctgagttggtgcctgcctgtccccactgcagtgggacagccagcagaccagggaaggggcaggcttcagctctcctctctctgctgccaccttggttcttccctccttctcacagctccgggcaaccacagccacaactgtcctcttgttctctgcctgagagcccctagagctctctgcctccttccccaactctggcgacaatctacactggacatctgtaggtttgccctgggcacccctccccagccattaaggtccaccaggatgtctagaaatctctaagcaggccagcctccccaaccccaggcagcagggtggaagggagactggccccaagtatcaagcccctctctaggcctcagacgaggagatcgtctgtaaaataaaggggctagacagctgccccataagctctcttgccagctctaagcctctgtgagtgtggcgccaggactgtttgatggatgtgtctggccagtgatgagcggcaggatcacccggcttctaggctgtccttctccctccgctttagcactgtccactgaacagaggctcaagtacctgcttcagaaaggcatgggtcccttatgggagaggcggggccgctggcggcggaatttcctccgacctccctgccagggccctggcccattccttgaccctctgggctgcaccaggtggcggacattgccgtcttccagcccattcccatcgggaagcggcatcagggaccctgcaggaaggagaaagcctgttagtgaggaaggttgttggaaacgggcaggggctgcagaccacaggcccgcgggaggggtggtctgtccatgtggtggcacttctcatagattttctttgtttctttttttcatattgagggaaaatttgccatttctgcactgtcctgggacaaacggaacctactactcacatcttgccattgatgtagctgactttctgtccttttgacagttatatcatgtttctgacaggcacaagtgggttctttctttggaacgtcattggggggtgtgcactttgggttgtcacgcctgtacttggctggggggcaggaggcagtaatcaccacggcacccctgcaactggtacacttcaaacatttcagacatatgacattacaatgaccctcccaccgccatggacccatcacccagattcaacagttatccagatggagtcacatatgctttagttatcccttttctattttccttgactgcagtattttaaagcaaatcccgaacatcacgtcattgtactcctacatcctttgatatgcaggatgacccacttgtgagtactagggagctcatatctcgcccctgggtgtctcatcggtggttaggcatctctagggcgccaagtcctcccagtggatggggctgggccaggcgggttaagggggagaggtctctgactcagcctgcctcatgctgtgaccagatttagagacctgagaccagatttagagaccaataaatattgcatgaatatttgagaatgaataaatgaaacaatggtcaccttcagcagcatgtctgtgcaccaggaggggggtgggctgttgcagttggtacctccccaccaatgccctac

SEQ ID NO: 2436 - DNA, 1900 bp, artificial
  synthetic oligo
agggagactaaagtgaagcatgtccgtgcctgggacagaaaggaaggctggagccaggatgtaagagaaccaagtctctgggggtgggatggaggctatggggagggcatcctgtgcaggggaggagaccagccaggaccttggggttagggaggagaagaccagcccagcccggctgggcccggccctgcctgggggaggctgcctctgctcacacatgcaggccgaaaggagcaacagctgggctccatgccgccaccccctccgcgcactcctgcctatgcaacaagtgtcacgtctgcatgttggcacatcatccccggtttcccgcgcccctggactggcgggaggctcccagccttcagggaccagaagacgttcaacatgggagcccagcccactcgactctggtcagttccttccatcgatccacgagggagcgggcatgtcccccgcctccacctctaccacgcggggtgcagggcgtgggacacgcggcgcacacctgtggtcctgagctcctgggactgcgagcgacggttaggagggacaaggtgacgggcaggtgatgccaaaggccgagttgagccccgcaaaagaagcagtccttgtggccagccgccccatggctcggggcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatcccccaggaggcaccctctacctggaatgcccccaccccacccttccgtgagcaattcattctttgcagcagcacctcaaatcccatcgcatccagaagccttctcaggata

SEQ ID NO: 2437 - DNA, 1700 bp, artificial
  synthetic oligo
cttacgagctgagacctcacaggcgacattttttaagctgctcattctgacggaacagtccccaagacaaacacaaggctttctgtctcccagggcttgtgcgacttggtttcagactctgccacccactgccgcagacagcggccgtcttcccaggaagaagacatttcctggcggggtaccgggactgacgggcggcggcgcagggcagtgccagccgggcccaggaagtgaacgcgctgggcccgcgaaggagcgcgtcgcccgccctgaggggggcagtgcagcgcccaccgcgcgccttcgccagtcccctggcaccgttgccctggccaggggccgggagagggcgtggcagcgcggcagtgcgcctacgcaccgggggcactggggatcccgcccccacgctggttcccgcgctttcaagagcctcagagccccgagacaagggggtgtcggctctacccacctggcccagcccgaaagaacagggccaacattttgaaaccaaaccaataatagaattggaatacttttgatcactttttattttccttttctggaggagagttgtggggcgggggtggggagctggtagagagaatctcagggcgctgtggctttgagggcgggttccctgcgcaagcagcagtgctcacagtgcgagcaatcatggctaggcccagcccgcggttagttgggtgcagggacgtgacaggaccgcgagggctgattctttagtctattgttcccactcctcagaaaggactcctagcaaatatatactgctagtcccagctttcccgatggaatggaaccccttgctttgctttgctgtcgctattcaggatggggattttgtccatgcagaaagacatttacattatctacactggaatgccggcccactagcctggcaaaatgctgagccagctattagatctggactcgtggaggagtggagatttgcctccattcaagcaaccacatacttccctggaagctgggaggagcaccactaagtccaccctctcctgcctggctccttggtagtgcttctcaaacattatcacttggacaaatcacctgaggtccttgttaaaagtctgatttagaaaatctggggaatccggtggcacccgagactgcatttttaacaagctcccaggtgatgcagctactgctgtgcaccacaccttgagaagcaaggggtacaacattgctctcaactgcggctgcacattaaaattaacttggggagctttaagaactaattaggccaggacccccacccccaagatattctgatttagttggtctaggtagagtcaggccttttttttttttttttgacggggtctctctctgtcgcccctgctggagtggcgggatcatggttcactgcagtttcaaactcctgggcccaagctatcttcccacctcagcctcccaagtagctgggacaacaggcgcaagccaccatgcccagctaattttttttattttttgtagagacagggtctccctatgttgcccaggctggtctcgaactcctgggctcaagagagcctcctgcctcaacctcccaaagttccgggattacaagcgtgaggcagccaccatgcctgatctgggcttttttttttttttttttttttttaattaagctttttgggtgattataatgggcagcaggattg

SEQ ID NO: 2438 - DNA, 1100 bp, artificial
  synthetic oligo
ggcttcctcacagcatggtagcagtcaaaccaatcacagggtggctcatggcttcaagtgtgattattccagcaagcaaagtggaagctgtatcctcttctacgacctcgccttggaagtcatctagcttcacttctgccatagtcacaaagctgcccagcttcagggagaaggaacatagaccctacatctcaatgggggagtgtcaaagtcatactgtaatacgctcatgcggaacagacgatactgtcacagcaattgtgggaaaatactccctactacaccaatcctacttcctgctcttccctcagctgaacctcagacaagccttttgctttcttgcttgcagctgtcagctggtccctcactctgggtgcccttctctcctctccagtgccttcaggccccaattggagtcccacctcttaaagtttccctaacggcttccataagcacaacaagcagcagttttcccttattcatagcaagcagacacttacatgtttgataggccaaagagttgctccacatttggtcagggccaatctgaccagtgggtaggtttccacatctgggccctaatacctggccaggtggaacatctagattctgaaacatcctcctcattcttccagggtctcagaacctcagggtgacatagcttctggccataaatgctaggacagagctatgttcattgtgcaatgtctcttccaaggtaggcacatgggcagatgaggctctgtgcagaaggccttggcagtcagatgagaggtggcagtaaaatgtgttggcaagagcctttggctgggaatcaggaagccagggtccccgaaccagctttctggctaatttgatgcattcatgatctgagacaaacctcccaatctccagttgacctcagtttccctacctctgcagtataaaacctagagcttgtccttcctacctgtgtggtgagcagacaagaagagagacagggctgggcatggtgactcacgcctgtaatcccagcactttgggaggccaaggtgggtggattacctgaggtcaggagttcaagaccagcctagccaacatggcgaaacccttccctacaa

SEQ ID NO: 2439 - DNA, 1100 bp, artificial
  synthetic oligo
gatgcatggcgatcccccaggagcaagaaggtccatttattcgcccaacatcttctgagcaccatatgtgccagccaccatgccaggcactgagaagcaaaagtcaaacagataagctgaaatagttgcaactccccacccagctactgtcacttttgcatctttgcttgtgttgtttcattcccctgcaccactctcctcattttgtccttctaggaaaactattgacccttcaaacccctggccaggaatcaccttgtttgtgaagacttctatcttaggacattcaggttaaacagaataccatagactgggtggcttaaacaaatatttatttctcacagttctggaggctggaagttcaaggtcagggcgccatcatggcctggttcttggtgaaggcctgcttcctggttcacaggtggccatcttcttgttgtaccgtcacgtgtctcttcttctagggggctctaatcccataatgggggctccactctcacaacctaatcacctcccagaggccccaccttaataccatcatcttgggagtcaggatttcaacatatgaattttggagagacacaaacattcagaccacgacaacttccccgagctcccgttctaccctcatgcccagcagagttacttcattcgtcctctgtgctcctgtcagtggacctgcatcagtgtccttactgtgctggactgagatggtctctggaaacccctggaggacagggaccaagacatatctttgtacctagtgctggcaaaaggcctggtccagagcagtggctccttcagtaaatgtttgtcaaatcacactgaaccaaatcaaactgaataggatcttcagctccatcagatttcaatttcatttgctttatggtcacctttgggaaaaagggagcttagaagcatttgctgactgtgacagagaggatgccgagagaggggctcggaggtgtttgatcaaatggaacattacagaagagtctataaatggagatcagggctctgctaccacccctacctcacgctccagttgacaacccaaactccagaggggcccatttaataagccaggaccaggcatcatt

SEQ ID NO: 2440 - DNA, 1250 bp, artificial
  synthetic oligo
aatcataaataaaactcatcttattcagataaagaaagtcaaagttatgtcgggaaggggaagggaaaaaagaaaaaccttcctggggctggaagggttttgtcacttcccaaaagtgaggggatgccgagtcatcacccgctgccagtcttcaagaaaaaggcacctggagcttgagtttggaagccgaagaacagagttcagcttcaataagcttataaagacgagagagactttccagccacttgcagattttaaaggagaaaggagagtgcaaagggcagaacatgaaaagttcgctactcaaacatacctgtacgcaccagaccattgaaatttgggttcatttggtttctcagaaaggtatcatattcctgaaccttgaaaacataattgcaagtgaaagaagccagtcagagaaggccacatattgtacaattccatttgtatgaaatatccagcactggcaaatccatagagacagaaaatagattagggatttcctggggctcaggggaggggggatagggagtgactccttagtgagtacagggtttcctttggggatgaagaaaatgttctagaattagatcgtggcgatggttgcacaacattgtgagtatgctgaaagccactgaattgtgcactttaaaaagattaaaatgatatgttttatgttatgtgtaaaatacacataacataaattatgtgtaaaatatgtagtaaaataaacctacaaaaatgtattgtacccaaagctttggtcattgttgaatagttttacctgttcacatgaaatatttttcacgacattaagttatttatgctcatatctgaacccaactaggacccttaatgtttatggccttcggccagcaaactcctagtcctgcctaggggtagactctttgaatatcttgcagggggcagggatagaagatgaaaactaaagtcatagaacccagatataagcatctgagaaaggacggtgctgtgacacagagtttaaggacagatttggagactgagaatgttatcaagacagtacggtgtctgtacagattaagagcgtgggccatgcagtcagacagaccagagttcaaatcccagctctacctcttgcatccatgaaaccctagacaagtcactttacctctctgaagcctcagtttccttatctgtaaaatgggatgggtaagaattagaacaatgcacatggagtgcttagcccagtacccgtggcttagtaa

SEQ ID NO: 2441 - DNA, 1350 bp, artificial
  synthetic oligo
gattttattaaagagaagaaaatattttaaaacttgattatggtgatggttgcacattttggtaaatttactaagagtgattgaattgtacacttgaaatgggtgaattttatgatgtgtagtttgtacatcaatgaagctggaaaaacaaataataaggatataatatgaataaatgcaacagtaaaacgatgtagttgtcttagccccctctaactgccaaggaaacagaggactagttattatagggttagcatatgaatctagtcctattgtgccaagattagtcatcagctgaggcaataataagagacatagaggtatatgccaggaaatagatatccttcctacaagtggaggttattcctctttcagaatggtcctcacccagtggcgcagagattaccctgagtggtgattccacacacatactgctagctgtacaagccagttagcctctggcagacgctttggcttgatcagcgttcttagtttcaagcaacaaataccaattctgagtgattgaggtgggaaagaaattggacagctcacagaatcttgtgaaggttgagaacaaaactcaaagctctgtagccaggaatgttgcccaaaaccatgctgtagattcagtccagtgagaagactgctttaactaatgctactgagtgtcctggactctgccccttcctctccaccactactgctctgggagatcaatttgcccacgactgtggctgttgcaagacagagaactcactactatcctagcttttatgtgactagctccttactcaaattcctatgcaggttttttgattggtggggtgtaggccacacaactacatccaggctgtgtgggaggctggtaaagtgagtatttgataccttctatcagcttccatagtgtgaaccaggctgaacttttcctcaagactcatatgttggttaattccctagacgcagagagtgagttccgatattggaccgtaaatacacacacacacacatatacacacacacacccctttccactgcagccttgctcaaactgtagtagtccacagaccagcaggtttggcaccaatgggaagcttgtcagaaatgcagaaactctggtcctgctctagattttcaaaatcagaatatgctttttaacatgcacctcagataatttgcatgtacacaaaagtttagaagtgctgctctactttatacaatatgtagtcctttttaattttcaaagatcagtcaccactactctctactgatccacagggttgctagagttaccaaataaaaatacaagactcccagttaaatttgattttcaaaataaacagcgaatcattt

SEQ ID NO: 2442 - DNA, 1000 bp, artificial
  synthetic oligo
ttttatccatttttaaattattattattatttttttgagacaaggtctggctctgctgtccaggctggagtgcagtggagtaatcttggctcaatgcaacctccacctcctgggctcaagccatccttccacctcagtctcctaagtagctgagactacaggcacttgccatcatacctggttaaattttggtagctcatgcctgtaatcccagcactttgggaggccaaggtggcgggcggatcacttgaggccaggaattcaaaaccagcctggtcaacatggtgaaaccacatctctactaaaaatacaaaaattagccgggcatgatggcagatgcctgtaatcccagctactcgggaggctgaggcgggaggcagaggttctagtgagccaagatcgcgccaaaccattgccttatccaaggtcacgatgatttacgtctatatttccttttaagatttctagagttttaagtcttatagttagatattgaatcctctttatgttaatttttgattatggtatgaggtaggggacaaaattctccttttgcttttgaataccacagccatttgttgaaaagactttttttttcctcattcagtggttatgacaccctcatcaaaagtcaattgaccataggctgggtgtggtggctcacacctgtaatcccagcactttgggaggctgaagcaggcagatcacttgaggtcaggagttcaagaccagcctgggcaacttagtgaaacccgtctctactgaaaatacagaaattagctgggcatggtggtacacgcctgtaatcccagctacccaggaggctgaggcaggagaatcacatgaaccagggaggtggaggttgcagtgagctgagagtgcaccattgcactccagcctgggcaagagagcaagactccatctcaaaaaaaaatcaattgaccatagatgtgtgggtttatatctggactatcattgtattccacttctctatgtttct

SEQ ID NO: 2443 - DNA, 1050 bp, artificial
  synthetic oligo
tgaaaacaatatattggttacgttgggataaataaaatattagttttgcctgtttctttttacctttataaaacggttactggaacatgtaaaattatgcgtgtggctcacattatatttctgttggacagtgctgctctggtatactcaaaaatagaatttgatctataagcatctttttagcagtacatttcttgctttaagtaagtgtacctgtacaccagagacaggctcatttcaaaagaaggacagggaggagtggcgatttgaaaatggggaaactgattatagaagaaagtcaggactctgcctcagttacctgtcagtctgggggtgggggatgctgggacaggggtcaattgcctgaagcaagtgctctcatccccctagctcctgctgatctagttggggctccagagtggggaggagaaaggcactttgaaacttctctgcccttaccgtcttagccatcaaactctgagctggagatagtgacgatgtgacaggaactttccctgggcctctctgggccacaattcctggccgagagaaagaggaggaatgaggtgagcaccttcttcactcctagggccatgtggtagagctgcagtcgcacctccttctgccaataggcatagatgagtgggttgagcagggagttgcccacgccgagcagccacaggtaccgttccagcactaggtagaggtgacactcctggcaggccacctgcacaatgccagtgataaggaagggggtccaggatagagcaaagctcccaatgagaacagacacagtacggagagctttgaagtcgctgggagtccgtggggatcgataacctccagccatggctcctgcatgttccatctttcgaatctgctggctgtgcatggaggcaatcttgagcatgtcgcagtagaagaagacaaagaggagcatggctgggaagaagccaacgcaggagagggtcagcacgaagtgagggtgaaatacagcaaagaagctgcactgccctttgtaggcagtctgctggaacatggggattccga

SEQ ID NO: 2444 - DNA, 1050 bp, artificial
  synthetic oligo
ttcttcagacatcacagacaaaaccttttcctttgataccaaaaaagtcttccttgtctccatactttcattaatgggtgtggctgaacctggaagaccataactcagcaacatagtattgatgatattttctgcagctaaacatattttgagtggacgaatgtttgtctgtatttggtttgagtgaagcactctttgattttcacctccttccatttctctgaaggacatggtgtgctctaatgctgattgtgcagagacaccggatatctgagatagtttttgcaaaagactgactttagggagatggctgtttcttcttatagctggatcaaaatgcatgatgtcttagacatcacttctacaatatgatggtttaagctctaattcaagcctttccattgcaccagtggttttagttgtatctcttgcagaatatctgacatatgaaggtagatttgaggaagccctgtcttttcttttcatatcttcctctgaataaaacaccaagccagtgatttgtagaggatcatccttgctgataactccttttaactttgaagtgggcatttctattttgtttgtgaattcagcccaattaacagtgtaagcgttttcatttccttgaggcagattttcctttggatagtttttgatcaatgactcatagaaacgagtacactgctctataaaagttctgatgatctgatttgttacagtgtttttttcaaatgcactaattgaagatggttacacttggcattttcctttgtctatcttgttcttaattataccaatcatgtaatagcagtattagtaagcaattctgaatggaatgaatgaaactattgaagggcatcctgtatgttttcctgggaaattacggtatttgatttagattcatcaggaaacttatgcagtggttgtaatttggggaatattttttcattgatgatttttgttggacagcaaaaagttttcaataggcattttcacaatttcagagaaagcatctgtagtaacatgcttaaattgtacgtctgcaaatga

SEQ ID NO: 2445 - DNA, 1700 bp, artificial
  synthetic oligo
taactgcaggaggccaggatgataccttgactgcaacctcctaagacaccccaggtcagaaccatctagctaagctgctcctatattccggaccaagaagctgtgaggtcattttttttttaaactgccaagttttagggtaatttgttactcagtaataaatatctaatggaacttctgaaaaaaacatacctccatggtttttagcaattggagaattaaatatcctgaagaacctaaatgtgtaatacctactagaaatacaatgggaatataatacaaatacaattatggtggagaatgtcaatgcacctcgttgatggctggacacatctagtagacagtaagaaaagatagtctagtagacagatcagtaaagacaggttaattgaatagtataatccataaatataacttaatattcatttagacttttatatactttaaatagagaatatacattttttgtatgtccgtgaaacactttcaaatatcaatcacatatttagccaccaagaaaacattaacaacttcggtatgctagagatttccaggctacattctctgaaactaataaaaataatgtgatgcaaaataataatttctcggtaataaagaaacatactatggacaactctcagatcaaaaaagaaattaaaaggggaaagtataatctacctgaaaaattacaccttatattaagatctatgggaaataacaaaagctgtttccatgggtattgatataaagtgttcttttcattgtttctctcatgagtctcagaccagtttctccaactgcctgtttggctattccacttagatgtcctattggatgcccacaggcaccttaaactcatactaatattcaaagctgaactaaatatttttcttccaaaagtgttccccttgctgtattgcctatctactgaatggcaccactcttcactatccacttagttgcccagtctaggaatctgggtgttgtcttcaactccttcattgcctatattcaattggacaccaaacctcagccattcgacctccttagtttaagtcagatctgggcccagttctctatcctcattgccaatgcctttgttcaggagtcatttctcactttgactattgtaataccctttttaattgtagtaagaagcgtggtattacggttaggattggttgagtgagaccgacatgggttaaaactctggctttgccacatgctgtgtgactttgggcaagacaatttaccaccctgagacttcgtttgcttatatatagaatgatagataaaaatagtagtgacttcactaaattattgggagagttaagtgagagaatataaagggtttacatggtatctggtacacagtaagtgttcaataaatgctgttattattattattgtttctttcctccaatttctttacttctaattccattttacctcttctgaaaaggcaaattctgaccatattatttcccatgctgctttttttgtttgtttgttttgactgagtcttgctctatcacccaggctggagtgcagtggcgcaatcttggctcactgcaacctccgcctcctgggttcaagcgattctcgtgcctcagcttcccaagtagctgggattacaggcgcctaccaccgtgccccactaaattttgtatttttatagagacggggtttcaccatgttag

SEQ ID NO: 2446 - DNA, 1150 bp, artificial
  synthetic oligo
gacaacagagggccttcaaaaaggagttcctcaagattcctcttttgcacaactgttttagagatcctacggttgggttgggccacgggttaccccacttcccctgcctataataatgctcatattagtttgtttatttacagcatgtatcgttaatgttatatatctcattttgtgtcttctagaatataaaaatttcaaaccaaaatgttactgcatcaaggatgtcagccactaagagaactctacaacactcctttggacacagcaggacaaaattttaggctgcaaatgctgttcagccgtggtcccacagccaccctgcccaatttaattcccaactcagggactcaggtcctcataacctcctgacagactaacaatcctaggtagggccaactctatgcccctggtcagcaataagcagttggaagatgagaccttcacccacacaccaaagatttgtcattgttgctctgtcacagggggaatgtggaatcctgtttagggaaaaaaagtcaggatggcagcaccaagaggaagcaaaaagaaaaagcagataagctatatgtctgcctttcttcatactccaagagacacggccctcctgagcaaataactcacaatcttcctgtgtccagctatcaccagaccctcagctaatagaaaagtgcagattggctcactgcaaccttggggttttcagtactgcacaaagccctcttcagcacacagcacaagcaccatgctataaaatccccagcaagccttcatctcctggtagtcagctcctctcttgctaacttgcccattcattgcactcttgctatgtgtcttcatcctttaataaatctgcttttctttacctacaaccgtctaggtaaattcttcttacctgcgtaccactggccccaaatagtcactgctcaccatggcaagtagggccatgcttcttctgaaacctatgagggagtccttccttgcccgtttctagcttctgggggtttgtcagcaatccttggtattctttggctttcaactgcgtaacttcaatctctgccttagtcattgtgtggaattatttttacatggccctgtgtgtctctgttttcatgtggccatcttcttataaggacaccatttgaaactg

SEQ ID NO: 2447 - DNA, 1200 bp, artificial
  synthetic oligo
gcttgtaaactgtaaaatcccccataatagtctttacagaacatttgaaatgtaccaggcattgtgcaattaacaaacgttaatcaattaggtaaacattacttaagtgtctactatatggaggacactattttaggtattgtgagccatccagagagataagggccatcagagtagatgagcccctccacataagaatagagcgttgaggacaggacctgagcaatgctcccatttagggtaccaaacgagaatgcagagccagaaggagaaatcagaggtaagaacaccagtatagcagtgtccgcagagccaagggaagagtgagtttcaataaatagagacttacaatgtagcattctgcagagaatgaaaatcaaaataggacagagatgtgtccccttggagcaggcctccaaaaaaaacattcgtaactgctttgagaggggctgtgtgtgtctgcacgtgcatgcacgcacgtgcatgtatggagggggtaggagccatcttgccgtggatggcaggtatgtttggggaaacgtaaggtgagcatatctagaatactctttcaaggtgttaaggactaaggctgagaaaggaagcatggatgatagctagaaggggacgccgggttgagggaagactgtttccatataggaacgtttcaatgtttttgtgggctacagggaagaagaagcccacagggaaagaaaagatgaataagtagatgacagagaggattactgaacagacagaagaagaattctgagagatgagacctgggaggtttggctgagagcagaggagttttcaattaataaggagaaagagatcatggggtagcaaatggctgtcaagtagccaagagggctgagagttgacaaggagccattgcatctagaattaggaaggcctcaagagtggaagtggagtgggaagaggtaaaatagtgagttgatggtagacactacacatttgagaagttttgcagacccaggagcaggtagaacaaggctaagggagagattatgctttacggggaggtttgagatgtgtgtaggaaggaaggagttagcggaagagaagaggctgaaggtagaagagggtcagaggtttcttggtggctgaggtggcagcagcagaaggggccgagcttcagaacactagtgaggagaaccccagagaggatcccttttttcc

SEQ ID NO: 2448 - DNA, 1050 bp, artificial
  synthetic oligo
gaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagc

SEQ ID NO: 2449 - DNA, 2650 bp, artificial
  synthetic oligo
taccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgcca

SEQ ID NO: 2450 - DNA, 1050 bp, artificial
  synthetic oligo
tacccacttggcctctgttgctctaaaggctcctgagccccctccttcaacaggacaaatgttgagtctggcagttccccttgacactgaagagtcatattttcgccaggggccaccatgggaccaggctgggctaataggctgggtttggggagtaagcctggaagaaatgaactcctggtcaaagagaagaggtcactttccagtgcatcacccctggggtctctgctcaataaagaggaaaggcaattggttgcctctcctcgagctctctgaaaactatctcccatgaactagtctattccctcctttctacacttccatgcccactcgacagcctcttccccttacctgtgactaggagttccagggtgttgctaggttgtatcttgatagaactggtccagtcagggtggtagcagcagctgtaacgccccatgctagtaccagatatattggtgatggggaatgccccgtcattactggtggatccccagagctgcattgaagtggcttctccttctttgtgcagaatgtatcctactccatggaccggccctcggcaccagagagtaacattctgccccatgggaaccacagaactgggctcagcaaacaaccatggcttagggaatgtgtctagaaagagaccaaggttgtaaagtggtgactatagaaacttatgagttcctgcttaaattaacactctatctttctcctcttgggcacggtagttcccctccgtggcctagcctagccttccaggaggaattactctccctaaccccttctccaatgatctccatcccagtcccatgtccggtcggtccttaccagtcacccagatcataaggggcatactgagatatgaccccctgtttgacatggttgtctcatagtagatacagctatagttcccagagtcctctgctccaacagtgtggagaaggaagtcagctgagttccctgagacactccgaaactgtaagggaacatgggctccctcctgcaagagggcgaacctcatgccctggaaagtcccttggcagc

SEQ ID NO: 2451 - DNA, 1200 bp, artificial
  synthetic oligo
aatgaaccagaagcctctatcactatcttgcaactttgagctcctgatgcctgtggaataacaagcaaagaaaaattcctatatttacagaggtactcaccctcatttctgtcagcagttaaagttgctgctacatacagagatagggaggattatgtttgaaactcaggggattcactgaagcatttcttagtgcgtctattttcggtgataactgtgaacatccaatttcaccaaccatggcccaaaaagagataggcaactgaatgtttaaacccttctgggatgatcccactagacaagtaacctaaattagccaaggtgtaagctaattgtgaggaaagcataaaaatggtagttgtagccgggcgtggtggctcatgcctgtaatcccagcactttgggaggctgaggcgggcggatcacctgaggtcaagagttcaagaccagcctggccaacatggagaaaccctgtctctactgaaaatacaaaaattagccaggcatggtggcacatgaccgagactgaggcaggagaattgcttgaacctgggaggcggaggttgcggtgagccgagatcgtgccattgcattccagcctgggcaacaaaagcaaaactccgtcaaaaaaaaaaaaaaatggtggttgtagagggagatgagtaatataaactatggtgctgcaatgagaacacatggacacaggaaggggaacatcacacaccggggcctgtagcggggtggggggcaagaggagggagagcattaggacaaatacctaatgcatgtggggcttaaaacctagatgacaggttgatgggtgcagcaaaccaccatggcacatgtatacctatgtaacaaacctgcacattctgcacatgtatcccagaacttaaagtaaattttaaaaaataaaaataaaaaataaatataaatatgtaaacaatatggttctgggacacagtatagtaacaggaactttatgttggcataataatcctcattcaataagcctttttaggagagtgtaactggccaccaatttgaaggattgcttcttcatccaagaaaagaaatgaggacatgttgttctcataaaatgatggctccaaattattgtatcaaggggtagactgcgtcagcctgaatttatacccctattctgtttacacaagaggagtccttggcctgccagaccct

SEQ ID NO: 2452 - DNA, 1200 bp, artificial
  synthetic oligo
acaggagggggaggggaaagagcgtagagtcggggagggtggggaagggatggtaatgcccttcctataggaactgcagcccgagcagggggcgtggggaggagggcgagcctgggaaaagcccggcgagggtggcgaggaggcgcgtgcccccgggagggaaagggtgggggctgcggcgaggggaccctgcggcgaggcggacgtcggaggagcccgcagcccggggctgcccggcactcctcccccgcccttcacacaaaggggcccagggaccccgcttcctgctcgcgcagcccagccggctcaggcctgagggctccgttccagttaccgctgcccgggcgggtttctgggccccggctcccgcgggggtcgtccggcctgtgaaggggagaaggacgcacattacccggctgacccccgccccgaacctgcggcgccggccgccgcctcccccaactcccacccggatcaagctactgccgcttaccccgccgtccgcacccgcccggccgccggggaggctctgtcacgccaaggccatggccacccgctggctcctctgtctctccgctgccccagcgctgctgctcgccgcggggaaagaagcgggggccttccgcggcggccgcagggactccaggcgaacccacctcttttttttctcacccaccccccacccccacccccacccccacccccacccccaccaagcacacacccggaagggtttccctgacacactggctgaggtgccccagttccccgagactggacgggatcacttccggtggggaaagtcccacctcttcggggcgagccgggtggcgctggagccgcgccctgctgagcgagcgagccggccggggacggtttcgggtcgggactccggcttcgggaacgggcctctggaaacctgcgacgtcagtccttacccgcccgcggctgccgcggaccgtcccacccccaaacccgtagaagcccctccgacctgcaacctccagccgcccggccctaggacttgagcggctccctggccggtgcggaacctgcgggctaataatctagcgaccgggagaacgccaaacatccctggactagaagttgcaggggaaatcaaacagcccagaaagtttattctccttgctggtatttcttccacttgctattttgctgagagatgcatgcaaactaccc

SEQ ID NO: 2453 - DNA, 2400 bp, artificial
  synthetic oligo
aaatgtttgagctaatttttcatttttcttatttttcattttaataggctaaccttatggaagtgaagattgactcatataaatgtgaaatgtctgaatatactatgtgtgtgtgtgtgtgtgtgtgtgtgtgtacatatacacacccttttgttctcacagttgctacatatgaaaatttgaaggtccatgtgtggcagctagcaacacctacaatacgcctttcagggtacaaaaaagtcactaatcctttcaaagggttataatagtcaaataattaaaataacttcatttcttttgggttccacacatttagacaccagcatgattcttgcccagtcacctgttatgtagcattccataagtttctctatgctccacaaagatagggttctgtgatcaaaggatttacagaaattcttgggttcaacagaactaaactacactaacacgcagttaacagaactaaactgtctttcatgcaatacctctcagagccttttctcagctaaaaagcattgtgatgctccttggagggaaaatataataggtctcccaaagaaacattaagtcttccagaatagacatcatttcccttccaacagatctgaatatatatcaagaaagggccgtttgaacaagtggtgaggaaggaggaggcattagaggaacaacacagaatcctgagaattatgaagctttgaaacatcatccttaattgacaccctgctaaaccaattatggttttctctaaactaatggttcccaaacttcagtgtttgccagaattaccgggagagtttcttgaaacacaaagtgccaggcctccccacagagtttctgattcagtaggtgtgggtgaggtgataatttacatttctaaatgtgtccaggtgaagttgatgttgctagtctgccacatttttgagaacccctgctctaagggaatattgtcctatccgacaatggatttagttatttgctatgcattttattatggtactgataattcagtttccaaaaggtcatactaaagaaatttggacaccttaattctacatctctgacatcagtaatgatgttagcagccacgtaaaagaaggccggtctaggtcatgaagaaggattggccttctcaaaatctattctactactcctaggaaacacattcattttctgtttacaaagtagggctattagttatgatggtaagtatgtatatgagagctctgtattgtatgttgcttacatttgctgtataaacatttccagagtgttttctaaatgttttctgtgtacccaaatttgaacgaataaaggattctttaaaaactgcccctcagctctccaataaactcacacctttactcactacagaaatcccaatcatttgagaacattaccccttctcctcacccctaaaaaaaacatacctagaaaaagacaagctaaaaggaggaaaatactttccagatcgattaggcaaacaatttaatgctgaccacagcatttcagcacagatgatcaaaagccgaagtatcaatagattactaaacctcaaaataagcactgaatacaagttcatcagttgcaccctgcagcgaggaagtaaggaaaaaacacatctcatacaaccctttctccttttttcctaatgaaaaaaagtaaacgtctaaggagtttcaagtatttgttatttattcctttctgttttacgagtagccccagctgcatctggtttacttctgagtatcactggaagcccattttaaactgaggcccccagttaaccatactggaatgcctggaatacattaacatgtccaaatgaaaatcactcagatagccttataagctgcaaataataaatgcagaaatggaattagccccttctcttgttgacttgctctcttactacttagacaattacattcttcccaaaaggcttcaaaatgaccttcaagaaagatatttttgaagtaagattattacagtaactgtaaagactgatataatgggaaaggtggaacaatggagataattgtatcaaaaacttcaaaattctagactaaggttaattgctgcagctgggcccaaaaggtagctgtgagttttctggcaacactaaataggaaaatgtactgaattgcatttgctcctgtagcctgataaaagaaggcatactgtttaatacctctcctgcataaaagtaaaaactgtgctagatactatggaagaaatgaagattatgccatggaaactgcccacaaggagtttacaaatcttctctctcccataactagaggcatgagtagttgtgctggtgggggacctaggacttgacgcctgcttggaggttgtgaacagtggggagatcaaaggtaactagtggtgcatgtt

SEQ ID NO: 2454 - DNA, 1100 bp, artificial
  synthetic oligo
gccctccagttggaccaggaattaggcctgtggaaagcaaaacacagaattattggtcaaaaaccctgacaccaagggccaagcttgtccgctttcatttacgaacacttgaagaatatttgtgggtgtagtaacactgtgttcaaggaccaggggctcccaagctgcctctccaaggataaggtaccaggcaattccctcccaaaaaatgtgaactggctatcttcaggtccagggccaagtactgagcagggaaagaaccaatgtccaaagaacctgaaagaaggcagttgctttgtgaatattcctcattggaaaagaacccgctgttaattattaatgaagccaggaatggtttcctagcttggcagtatcaggagctcaaggccctccattccccagtgctgtcctggaagaagtttttgctatagaagaaagctccagttttagcaaagaaaacaccagcaaagcaaaggctttggaggtagacaaacctgggtgtgacactcggacctgccgcttgctagttatgtggcttgagacactcctccctgaacctccatttacttttctgtataatggggagataataaagtttacctgcaagtgtttttagaaaaatgaaataaagcttctttcagagatacatacataacaaaatatatacagatgatgtccgggagttgctttaatatattacagattgtagggaaattagtgaggacacagattaaattagattggctgagttgataattactgaagttgagtgattgggaaaggaggttcatgatgctgttctccctagttttgcagatagaatctttccataataaaatgttttaaatcatgaataaggtgaagatactgcactctggatttagaactaggcttgattctaaagtattaggcaagttaatgaagctctcctgagtctcagcatattcctctgtaaaatgtgggaaagaatttttcctgcctcactgggtggttgtgaagattaagtgaggtgatgcagaccaggcacagtggctcatgcctgtaatcctagcactttgggaggctaaggcaggaggattgcttgggctcaggagtttgag

SEQ ID NO: 2455 - DNA, 1000 bp, artificial
  synthetic oligo
gagcattcctgctctggccttgggaatgatctgtgtgtactttagacaaacatgtgatccataaaaacttgcaagaagaatttggcctagagctgcccctgcaaaaaagaaagattttgaatcaattaacacaaccaactatgcaactttgtttcaattttaaaacaccttccggctgggcatggtggctcactcctgtaatctcagcactttgggaggctgaggcaggcggatcacgaggtcaagagattgaggccatcctggccaacatggtgaaaccccgtctctactaaaaatacgaaaattagctgggtgtggtggcacacacctgtagtcccagctactcaggaggctgaggcaggagaattgcttgaacccgggaggccgaggttgcagtgagtggagatcatgccactgcactccagcctggcaaaagagcaagactcagtctaaaaacataaaacaaaactagcaaaaaaaacaccttccttagggcacaagagaagccaaagaggtcggtcatgatagagacctccacacaacagcccaggatgccagatcatagtcaaactccgcagtaatgatgagaagtctctcatggttccttgggacccccacatgtgtttccaccctttccaactggctatgtgagaatagaaaacccaaatcccagctcagtcttggtctagcacaacatctggcccaagatgactgccaaagacctccccagacttgagtggttgttctgccatgtgggagaggttccccaacacctcctcctctggaaggggggggcggcccatggcagaaaatgggcagcagagagtcagggatgttctctctgcctctacctcagagacagccaagagtatgaagtccaagtagagcagaagtccaagagtagaggaaatgaagtgcaccccccagtgacaagaagctgttgaatactctctaatgagaagcatgattctatgaggtaagcaatgaagctacagggaat

SEQ ID NO: 2456 - DNA, 1450 bp, artificial
  synthetic oligo
aagacctacccctggtgaataaaacacctcagggatgtagaaatctgttcttctcccaatgggtgtggtacccccggcccaatcactcatccaaactgaaaattttagagatgctaaaagtctagggtacaacatgaatatgatcagattctttgacttgtatagccatggaccctgacctctcaaccccattctgtgcatgctggccagcatgatacttagtgatgaagaagggggctagtgctatttctttgggcccagttctgaattccctctacagaacaaatggcacactagagttggctacaaacagaggaaatttggcctaagaaaagcctgcagaatttgggacttttaacagcttgtgagcaacaatgtttggatacactttcaaaaatggtctcagaaattctaaaatgagcaggaccctgagtgactgcaaacaacatactggcagacagatggatgaaatccaatttctgattttttttaaagaaatattattcttaataaacaacttgagcctttcaccagccaagctctctctctctctctctctttgtcctctccaggcaacgtgatcacggttgtttctattcagcagttatatatcacccaagcacttaaccatccgcggaggcagagaagcatcccaaatgtagcactggaagcaggattcagagtcttggcttgcagccacaatagcctctgatacctccctaatgtggatgaatggctgtgagtcagtaggtggttcctgtcgcagctgaaggctcctactgaagctcatccaaccaggcctcagcccgctcccatcctgctcagctttgcagggattcccaacatggcaatgaaagacccctctgcaatctagccacaaaacctatccccagtgaatagaaagccttagggatgtagaaatccgttcttctcccaatgggtgtggtaatcctggcccaaaaactcatccaaactcacatgttgtaaaatgactgacgatgataatgatgtaggtgataacaacaacagccaacatttattgtgttcattcactttgtgggaatgactaactcaagacctcactgtggttttgcaaaaaacccttgttcatcaaggtgcagtcaacagagcaagggttgtggagtcagacagaagtgcagtcagattcctgctgtgccgctaaaaaaactcagtgaccccggggaagccctttagcctttttgggcttcattctcatctgataaatggggatccttttgtccactctggcctcttgctgaagatggtgcaggtttacagaggaataccagagataagggatatgaacgcttatcataaactggagtgcactctctacacaggatctggtcgagggtcacatggctggttagtggctggcctagaactaaggcccagctgtctgaactcccaggccagaaaggtggaactg

SEQ ID NO: 2457 - DNA, 1050 bp, artificial
  synthetic oligo
ttttcattgcagagatgagaaaactgagacacagaaaggctgagtgacttgcccacggttgcacagatagtgaacaggagcaccgagatttgaacacagacagtctagcttgagagtctgtctgcactcttaaccattatattacttaaacattatgttaagctgcaatttctgaagtctccgtcattaaaaccttctaatgatttatccaaacagaaggattttgtattttattttcccccattaaatttgaacttctgcaagctattttgatgcaggaggcactattagctggcagcatgttcagaaacactgcagcaagttaccttgtctcccagggcaaattttcctaggtaccattgctaaataaatagaggtggggccctggagcctcagagcctgccccctacccaccccacactccacgatgttgcctggatgcatcttcagcccacacatcccattttgtgtctgcaggctgggtcaaggaggttgacagagttttcattctttacaaggttgtcattaaggacatacatttttatttctctccattaaattgttgattccattctataaaagctaaaatgtagtctccaagtgtgggacaaagtaggcggcttgccatgcatctgactttctatttaatttagatagaaaggggttgagagatcacagtgcatgatttagccttatacctttccatgcaccagaaactaccacttcataggaaagtaatacaaagccagaatgcaccttgctccttgatataggattatgcctagtggagaaataaaagaatgacttgcagagcaaggtgttaggactaggccagtccagttcagggctaataaggatttactttgactcagtttgttctgtcggggagttgatcatttaatgaacaagaaactgtcactcttgggtatgttctgcttcactgcctttctcacccagttcccttgcaccatccagagcagactgacccctatctacttgtctttctccttggaaattcccaacatggagggggcattgttcagccaagac

SEQ ID NO: 2458 - DNA, 2750 bp, artificial
  synthetic oligo
ccggcctatttatttattttttgagatggagtctcgctctgtcacccaggctggagtgcagtggcatgatctcagctcacgcctcccaggttccagcaattcacctgccttagcctcccgagtagctgggactacaggtgtgcaccaccacgccaggctaatttttgtgcttttagtagaaatgggtttcagcatgttggccaggctggtctcaaactcctgacctcaggtaatccgcccacctcggcctcccaaagtgctgggattacaggtgtgagccactgcgcctggcctaagtctaagaagatcatttattgattcaacaaaatacaatgtttaaaatctataacacagtgaaaagcatgggcttgtcacccaaccaaatcctggaagttgtgagcaaactttgaagtaggaagacagtactttggggacaaataaaaggaaacaatttcacactgtcagtagtgtggaactagttgcccccaatgggttttaaattcaagtagggtgcaagagtggtttagagaaattcctgagtggcaaatgaggaaaccatgggctctctgagatacaagcccagtcttccgtaggggcatagccacggcacaatgctctcctgacctaacgtccttaaaaccttggtcagaagtcagaccattgtgctaatgcgtgagggtgtgcgtggggatggagggtggggtggaactcctgcatagttagcaaccctgcaccaaatcctggcaaccttccagagcaaaccctccaccatgtcatgctaataacagcagacctaggaactgaccctatgccacgccgtctggacccgcatacagtcatagtgtccaggtggctttgtgagtcacccagaccctccgaaataatcccactgcgggtggggctgccttgcagtttctggccccttcccaccctgactcagctttccttccacgagctcctatttcttgccgggcagaagccgccgcggtacccgcttcaccgggcatgctcagtcctccggccaggctttgactgcgggacgccagcgtccggccccctgcgcgcgtccggagtccgggtccctttaaatcgggcaggctcgttgctaggcaaccgcgcggcccgcgctggcgctgcactgcggtggctcagcccggagccggcccggcggggtcgcggtggccagagccgaacggggggctgccgcgcgcgggtggtggttgtctttgaggaagagaggttcgggctctccagacggcatccacgcttccaggtatgtctgcggacgggaaagcccgggctcccccgggctcgcccctcttcttcccggacacagggggcgaaggggcggggagccaggggcaggcgcccaggtccgcaccccaacccccactgcaagttatttctgtccttagagccccaggccggggctggagagcgtttgggagggaaaggaccaggacgtgggagtggcagtgcggaaagaggagtggggtcaggcctctcccgccgcccgccagcgactaggtcgggactggggaggtggaaagtgtcacctgcaatggggaccgaagcagcgccccgaccccgagccaccttctctcctcgggaggcaacgatggcaggagtttcagttaacaatttacagagaaaactcccaaactatgcatacaaagatacagctttgtagcaagaatgtgactctcatactaataaagtctcagccttcggaattaaggtgactccccgtatcttttcttctagaaggaataacttcacactaataacaaagaactggggagtaataagcattcacggggcccagttttcaatggtacttttcttccccctcaatagctgccaagcaatagagaagacaatttgtcccgggaagtggacactttggcccatatattaggaccctgacagatgaaggcaaaaatcaggatgacttcccttttcgatgtttttttgtttgtttgtttcaaattaactacactctgagggagggaggcaaggcctgggctccagccttttgctaatgcggttcctggcgtgctcattaacaacaagccagggtggctcctttgctcaataggtgctaaaagtgaggaggtactgtgttgaataaaatttcctcatgattcttgtcccatttgatatctgtatggcttggggaaggaagacttagtggcataatagttggggaaatgggttgacaaaaagagaaattacctcttagtgtctggtatcacatttcagatagaccaaatgacattctaaatatatcacttgtctttttttttttttttttttttttgaggcggagtcttgctctgttgcccaggctggagtgcagtggcgcaatttcggctcactgcaaccttcccctccctggttcaagcgattctcctgcctcagccgcctgagtagctgggattacaggcgcgtgccaccacgcccggctaatttttgtatttttagtagagacggggttttgccatgttggtcaggctggtctcaaactcctgaccttgtgatccgcccgcctcagcctcccaaagtgctgggattacaggcgtgagccaccgcgcctggccatcacttgtcattttaatctacatctcagatataaacacgggtttgggcattctggttaaatgtatttcctgattacagggagggaggcggaattttcttttttccagttcaaactggagaaggagggcagagatatccagtagacagaa

SEQ ID NO: 2459 - DNA, 1000 bp, artificial
  synthetic oligo
agaccaggttccagataacaaactgcagaaaaccattttgctgatgctactctacctttggatgctatcatttttgttttggaaacaaaagacctaggagatttttatcataagccaagtctgccgtgagtaggctggtttcaaggagatgtatgaaagagaaacatcacagttgctcctctctccaaagaagcatagagcatagaggttaagtgcacaaactttggttatccacttgctagctgtgtgaccttgggcaacttgtgtaattctctgtagctcagtttcctcatcttgtaagacagggtacataactagtgtttttgagaggtaagatgagatcacatacggtcaataaatgtcacccttgttattatcattattgctaatcgacaatgggaaattgaccaaatctatctgtctcctcccagctattactctcaccaagctttttatacctattgtgttccctggagagaatatgatgaactaattcgtaatatgtgtatcaatgatgtgtgtatatatttgggaaggtggaacaagttgcagagaagacatgttggttttattagtatatgaagccttaaggcaaagtaacaaatctattgtgatggctcttctggcctcaggaaggatcctgtagagggcatttcttgggttagagcctacccaccccccctccaatcaggtctgtgttcgattggcccctggctctagcaggcagagtaccagaagggggaagaaagccctgctctagtgctccagagggaaaaaaaactcatctaggaagagggaatggagacaagagaagctattatagcattttttatttccccttggcacaaggagctgtgcagctggggacccactactacagctgctcagataaaaataagtcattgtcttgtcctttgtactcatgagacactgaagctatagttatctatgtattgtaggtgtaccctcctttccatactgagtaccaaggtgatgtctc

SEQ ID NO: 2460 - DNA, 1400 bp, artificial
  synthetic oligo
agaatacgcctcttcctctgttcatactctacaacgttttgtcttttaattttgcatatgccttcgtcccccacaccccaaacacacgatgtaccttctctcggcgcattctagccaaacttccacaatgtcaagtccctacggggaaaactaaacaacctttaaagttttaattcgggagagacaatgtgaaattaatcacacatttctttccaagacataactaacttcttgcaaataagaggaaaagttcatttacattctgtcaaaaccagtcgctcccgaccctagcgaggctgacagtcggtcactgccccttactcagttttctctccccgcccctccatgttagttgttgttttttttttcccagtccgtttcctgagaatttcccggccgcactcatttgttaaacactttaaatgtcagatttgcccccatcccgcccgcaaaacgtgctttacaacccccccaaacgccacagcacttttttcagaattatcaccagatgtttttctgcctgccgtaacccacgttacagtcgggaaagacgccagccaccaagtccctttttaaaaaatcgcatgtcacctctggctccactcgaaaatggcgccgaaatcgaagaacttcttaaatttcattgcaagctttttgcaaaggtttctgggatttgcctgcgaagctgtttcgccgcgtccgagagcgagcgaacgtgcaagccagcgagggagacagggaggaaggaagggctggggaggcggagagacagaccgagcgagcgacacacggacagcgacggacagcgacagaagcggggcccgggacttgggagacggcgaggttgcggggcgcgaggtgctgggcacggagctacagggacggagagccgagagccggggtcgcagcgtggagggggcgctggctgctgccgaagctcggagagcggcgtggcggaggcggagcggagccgagcgaggggccagcacggaacgctcccttggaggcgagcggcgcagccggcggagaggctcccggagccgccctagaaaaagccggctcggggggcgtggccacgcgctgtggcgctccccgccccccggtggccccgctcggctccggggcccgggggcggaaggggggaggggaggagaggagctgtagggaagggggttgtgcaggcgctcgacgccgcagccttggcccgctgcgggggagggccgagaagggcactgggcgcccagagtaaccaacaccgagacgaatagcgagggctcggggagaaaaaacggaggatggcaaacggcaaagccaagggcacgaggtagcgcagcgcgcacccagaggctcctgggacggacaccaccccacgctcacgggtcctctggcggtgtcctttg

SEQ ID NO: 2461 - DNA, 1100 bp, artificial
  synthetic oligo
attgaaaagaaatacatgaatatgtcaatagttggatggtggcattgtgaataattttgattttctccttttcacttgtcagtatttcagattttactattaaatttgggggccaacatggaaggaggaagtaaagccaggagccacatgaattgctaaattttaaaagtccaggccaggcgcggtggctcacgcctgtaatcccagcactttgggaggccgaggcgggtggatcacctgaggtcaggagttcaagaccagcctgaccaacatggagaaaccctgtctctactaaaaatacataattagccgggcgtggtggtgcatgtctgtaatcccagctactcaggaggctgaggaaggagaatcgcttgaacccaggaggtggaggttgtggtgagctgagatcacgccactgcactccagcctgggcaacaagagcgaaactccatcacaaaaaaagagtctggtggtgatgtggaacaatgacacagatatgagggaagtgtttttaggctgagaggaaaaaactagtgaggaggaagagcttgcccaaagggaaagaggatggcttctggggccgagtgtaggagaaagcaagagaatatagtgccaaggacacaactggaaggggtaaccttgaggaggaagtacctccttctcatgaaggtggtgtgggtggatgaacaggcatgggtgaatgtgcagagaagtgggggaaagtgaggtgaagagggggacattgaaggagttcctgcttgataacctatgtcctgtcattgaaatccaaagccaggcccagtaccaaggggtctggcacaaggatggggtaggggatatgaggagagggagaggagttggaacaattgctgagagaaatttgatatataaaaggactgccttgcagcccttggggcccagctgaggctggctggcctggctttgtagtggagccaacttcatgaccttctccagcaacagctagccgcctgggagcaggcaatggagagaatgtatggtggggctttcacagggccagggattggcagagcaggtgctgccgaaggtcacggggagagtgagtccgggagatcaacgct

SEQ ID NO: 2462 - DNA, 1050 bp, artificial
  synthetic oligo
gtgatggctgaaatgccaggcaccgctgttggttagaccagagaatcattttggtagatttcatttctgggagctgcaaagttaattatccatagccagagatccttgcatgtgtgttagtcagcttaggctgccataacaaaatactacagattgggtggcttaaacaacagacattgattttctcacagttctggagtctagaagtccaagatcaaggtggctaccagggttggtttctggttggtttcccaggagaagctgctgtggacagagttattggcttaattggccacaatagactccacagaaagaacatgcttgtagagtgatagacactcattcgattaaaccattgcactgccatgctcaaattcatccaataaattgctcaatgtttctgcttgtgcaggcacagactaaaaccaagaaatagactgccatctagagtccgtttatataatggggaaaagggttcaaagattagattatttgttctatccatacatgggcaagtcatttccccttctgggatctcaatgtccttgccagcaaaatgagaatgttgccttagacccgtagtttccaaactcagctccacaaaacatgcatgcctttaatggtttgtaattagagtcgctcatcagaatgatccatgatccttgaaaatatacatacccccatgcttcaccctagatactctgattcagaaggaggtgtggagcagagtgagggcctgggcacacgtataaaacaaaaaaacatttcacaggtgcttcccaagccctccccaggtaaggaatcagtgatacagatgttaataggtactcctttaacaatggtgctatggtttggatatggtttctttggcccctctatgtttcatgctgaaatttaatcctcagtgttagaggtggggcctggtgggaggtatttgggtcatggggctggatccctcataaatgacttggcgccattctcacgggagagagtgagctctcactcttagttcccgctagaactggttgttgacaagagcctggcacctcc

SEQ ID NO: 2463 - DNA, 1200 bp, artificial
  synthetic oligo
caaaggggagaacttccatcatggccagaagacctcacactcttgccatgaagcccctgtcctcaatctatcagattatagagttcagagttcttccctggttcatgcaatgatgcacatggcagagccatactagcattcattgtgaataatacaaatctacaagtggaatcttctcaaacattttattggaagaacacaaatattttataaaatgcaagaaaccaaagtgacaaacactttgaaaacacagaaatgaggccgattgaggtgaactcaatggcaggacttctaaattacattatctgtagtgaaaaagtattaacgagacttaacaggttgtcactcattcttcagtctaatttcaagagcatgactggctcaactagggtgaggtgaaaggtaccaaaccaagtagctatggccagtcacataggaaacagaagggtgtggaaaggtctcagagaaaagctgcttcctggacagaccaatcagcctgagactgctgccttccaccccagtacatagatacagtacatacatgttttgacccgtccccgtatgtaaaatatttaaaaccatctcttgagtaagtactaaagcacatatcatgaacaatgaaaacaacccaaagtccaagccaatcccaaagtcaattcctgtttgtatgtataaatagctggtgtcatggggccattccttgagacaaagtcctccagatgaagtgcatggcttctgtagaactgttggatttgatgaaattcaaaaacctatggactaaacgttaaccttaaacactgccaatgtaaaatactacatgtaaattgaagaatcaaggcaaaaaataatatggaagcagtaatggcattacccatttcccatggagaaccattctcctttccttgtgttctaaaatctaaaaacatttggtgaggagaattcatctgtaatcataaaaagttctatgcttacctctaaccccaggttcccagatccaccatttctggactttggagaagcacaggtgcttgttttctggcttaaattatattccacatcctgtagatcagcatgttgactgcagaactagtagtccaagctgacactggagtggagtctacaacaggcctttctagcattctgtaaggcatcatgtctgactgatggggagaccgggaaaatccatgaatcccactagga

SEQ ID NO: 2464 - DNA, 1200 bp, artificial
  synthetic oligo
aacccacaagcgtgcatttttccctttctgttgtatttgctggtcacgtatatctctgtgttggcgaatttccccgttgtccttccctttctcagcagtcttcttgatccatacaatgttgtctcgggttttcatttgctcttatttatggcctttttttttttttgccggtgtgcttaaaagcccttttgtggtttcattcaatctttattaaatgtaaaccaatcaaaacccagtagcgttttttcggactgtttaataaagccgggaaatactcacactttgttatggtcatgacttttgaaaaactgtccgcaagaagaaggttcacccgaccccatcccagttttcacagcaaagattgacgtgggtatttaagaactctcaaaatacctgttcgccgtcacacttgatcatctctatggtatcccacgtaactgtttaaggaacgtagtagattcatatacactgattaggcaattgtcctacctacatgatcatgtaaaaaaagacaaaactgagcatcaaggaaactgaaggaaatggtgtggtgcagggctgattggtagtccacttttccacctgctgccaaacacaattaaataattttttagagaaagggtctcactctgttgcccaggctgcagtgcagtggtttagtcatagctcatggcagccttgaacttctgggctcaggcgatcctcctgcctcaggctctggagtagctaggacaatagatggggctacaaattctatatccatgaatacatcttttaaggatgaaatggaaataaagatattttcagataaaagaagattaagagaatttgtgagtaacagacctatgcttaaagaatggcagaaagaagttccctaaacagaaataacagaaagatgatggcatttcaggaaggaaaaagaacaattggaaagagtaaatataggggtagatataatagaccatcctcctcatgagtttttaaaatgatgtttgatggttgaagcagaaactattatgtcatctgatgtgatgcttaatatatagagaggaaatacttaaaacatttgtattaaaagtgaggcaggtaaataaacctaaatggaagtaagatttctacaacttactggaagtggtttaaaatatccatggtagtagaatgtgataagttaatatgtatattgtaattcctattgatatg

SEQ ID NO: 2465 - DNA, 1750 bp, artificial
  synthetic oligo
cttcttcaggaagcttaatcatttctagtttttgatttaaagtgagagacttgtgagtcttcctgtcacttgaacacttagaggctattttggggttattgcttggcctaatttccatattgttgcgcctcagggaataagatatcctgaggagaaggagagagatggggaacagcttgtcggtggagtcatcagaacacacacaacattcgtttagttcgctgctgtctgatatgggtgtggttcttggtgccccaacagaatgacaatagtaacatcaaagatcactgatcacagattaccataacagatatcacaggaatgaaaaagttggaaataagagttaccgaaatgtgacacaggaacacaaagtgagcacacgctgttggataaatggcaccaatagacttgctcgacatagggtttccacaaaccttcagtttcgaagaaacacagtagttgcaaagtgcaatgaagagaagtgcagtaagatgaggtatgcctgaatgtagaagccgtaaatggcactttattaatgttccctgataggagaattctccccgttgggtgtaaaatctgaaaacgttgagggaaggggcacacatctgtaatcatgacagattccatgctcatgtctaagtacaagttcccagagcagcgttttctgggctacggaggagaggtcaagatgtctcacttctggcataaagtgcactccacgtgtgttggctcaacactctaacagaaaaacttgtagtccccaagttgatactagaatggagtctacaagagacctttccagaattctgtaggacaggctgtgtctgactgatggggagactgagaaagtcatagcaattcactagacacagcccactgctgttcttggccaagtggatcagaagcagtacagcagttctgcatacaaataagaggaggtgaggggagctcagaacaccgacccaaatccacaacattaggaggccagctaggatggcagtcagtcttccttattttgggatatcatagtaagcacaatgggctgagagggcaaatgccaatgcataggaacataggggagattaccaaaattacacgtgtgtgtgtgtgtgtgtgtgtgtgtgtgtgtgtgtgtgtgtgtgtttattctctggacacgttttgagagtcttgcctattcaaataactccaacacagaatctggtccttacttggcgccaactattctttcagcttctgtgtatcaaaagtactaaagatcaggtataactccctgtgaagacatagttttgaataaagcatgagaaggggagaggtgtgagcaaattactcgtcattcctgcttgtgccttcaggtcccatttgcacaagatccacttgatggggttgtctgaaaatgtgtcgctttgcccagattcgggaatatacagttgtgggtggcaattggtgacatgccatcatggtgagatgttcccaacgattctgtgctcacccccaaactcaagttccaagaccagtcttttctggactacggagaagtacagatgtttactttctggcatcaatccaagtgaagttaatgaaaagaagaagggagcatggtctctctctagaacaccactgtgcattggcaagaacctcctcttgtggcttgtcgtgatctacataacatgtcttgatatgctgcacaaacaccctcatgcactgccccttactgcctgctatggttgcttgcatcccagcctgaatc

SEQ ID NO: 2466 - DNA, 1000 bp, artificial
  synthetic oligo
gataaggcacttccctaagctgggttcatggtccaattgaactagccagtatctcaattagatttgccagaaaagtcatatgtaaaatagtatttaggcttactaagctaaccttttcagttaaaccagcccctttactgctcttaaaaggaaatataaacagaataaaaatgttttgtcatgatttttgtactggggtgatagaaaccgctctccacttaaagcagaactgaatgctctccaccatgaccacattgacgatatcatctacttgaggtacgtatccatcaggaagtttcacagaatccaaggtgaaaaagatagtattctttatcaccccacttcttccacgtatgtgagtaatgcggacctgtgagtataaataatggaaatgattatgagaaagcccgataatcactgtaaccagctttgcacctcctcactctgggtcctgcatgagtgcaggtcacttcaatgcaaatcattgatttccaacctggttggcccattgctaacaccaggggtgctttgtaagaatacccatgtccacactccaccacagaccaattaaaacaggctctccagggatgaggcatgggtctttgatgagaaatccagctctaaatattaccaaaatatgtccattaccctctattgccctgaatttgctggtcatgttcaggctccaatacccaaatcattctcaacatttactgttaagctcaagtcccacaacgcactccgttcattctttccctacaattttctgacacaaagattgtttttcttcctcctgttgttggaagattctaataaaatttgggtattgagtaaaatgcacaatttagaacttaatcgattaatatgcttgttctacataattttctaattatttcctttgggaagtcctgccttttcagtaagaaaagtggctcctttgttggcaaagaatgtatttcttcatattttctggaattcccattacacccaacagaatcct

SEQ ID NO: 2467 - DNA, 1000 bp, artificial
  synthetic oligo
ctctggatatattttgaagttagagaagaacccaggaggtaatggattagatctttgatgtggagaaaagatgagtccaaggtacctccaaagtttttggtttgagcagtggtgagggtggagttgccagttgtgatatagacgactgaggcaaacaaaagttggtgaatacggagaataccaacaactcagctttacacacgttagattggtgtaagcatatggataattgaccctgaggttggttagagctggaggcatatacattttggagttattggcccatagatatacagtaaacccacacaaaagaaatgtatgtaaattaacagagacagagacagagagagagagaaagagagaagagttctaaccctgtgtcttgtatcagtctacaatgctgggtcctaaggtgaataaatgtttcactttgttgatattgctagttttctggagtcattgtggcaacttagtgtctcagttgcagttgggatttccatttgctccacattctttcatgtacctttgttatcctgtgactcacttttaacttactgtaaacttctgtttgaaactcagtggtcttaactgtaacctgtaaggcacatacttaagagttcatcagcggaacacaacaccaggggaaattgattcattctgaaagtaacaacatttcctagtggtactgctaccactactaccaatcaacagatattttgtggttgctatgcgccagcgatgattctgtgcgtatcgcacatatcaactaattctcacagcagctgtgtatcatgaaggcgacttatcgtgcttctcattttatagatgaagaaaacgaggcacagagaagttaagcaccttggctaaggttgcaaactgagtgagtggcagtgtcaagattcgaacgcacatggccaggttcaaacttgtgctcttacctacacgtttgactgcctctcactaaggagttggaacacaaacagttgtttagtaaaacatg

SEQ ID NO: 2468 - DNA, 1350 bp, artificial
  synthetic oligo
tggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcctaaatagtattttatatatgacttttctggcaaatctaattgagacactggccagtccaactggaccaggaacccagcttagggaaataacttattaattaaaaagcatgctaaattagcttgctagtcactggaggaaaggagttcttaattaaaatgaacacggccattaaatttgaattccatatttcccattagcagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgcactaagacctctctgttgatttttaaacaacaccaacaaccatagaaagtcgactctgctgtacatgagcctctgtgagccactttgttgcaggggtgcagctcatgtgaagtcacgaagaaacgtacaaacacagagccccttgagggaaggacaagctgcttacccactgggaaaggttatactaaaatcccacaagtaaactccaggaaacttcatgctttcttctaatagaatatttaaccaggtagctgtgacctaggggaagggatatattcagacctttgggcatagcttgagtgtcgttgtaaacttaccctgagtcctgtgattcataattccaccattaccaccggtccttgaataaacagagttgtgttttgactttccactacagatccagtgagacctctcag

SEQ ID NO: 2469 - DNA, 1100 bp, artificial
  synthetic oligo
tcacgacaagccacaagaggaggttcttgccaatgcacagtggtgttctagagagagaccatgctcccttcttcttttcattaacttcacttggattgatgccagaaagtaaacatctgtacttctccgtagtccagaaaagactggtcttggaacttgagtttgggggtgagcacagaatcgttgggaacatctcaccatgatggcatgtcaccaattgccacccacaactgtatattcccgaatctgggcaaagcgacacattttcagacaaccccatcaagtggatcttgtgcaaatgggacctgaaggcacaagcaggaatgacgagtaatttgctcacacctctccccttctcatgctttattcaaaactatgtcttcacagggagttatacctgatctttagtacttttgatacacagaagctgaaagaatagttggcgccaagtaaggaccagattctgtgttggagttatttgaataggcaagactctcaaaacgtgtccagagaataaacacacacacacacacacacacacacacacacacacacacacacgtgtaattttggtaatctcccctatgttcctatgcattggcatttgccctctcagcccattgtgcttactatgatatcccaaaataaggaagactgactgccatcctagctggcctcctaatgttgtggatttgggtcggtgttctgagctcccctcacctcctcttatttgtatgcagaactgctgtactgcttctgatccacttggccaagaacagcagtgggctgtgtctagtgaattgctatgactttctcagtctccccatcagtcagacacagcctgtcctacagaattctggaaaggtctcttgtagactccattctagtatcaacttggggactacaagtttttctgttagagtgttgagccaacacacgtggagtgcactttatgccagaagtgagacatcttgacctctcctccgtagcccagaaaacgctgctctgggaacttgtacttagacatgagcatggaatctgtcatgattacagatgtgtgccccttccctcaacgttttcagattttacacccaacgggg

SEQ ID NO: 2470 - DNA, 1000 bp, artificial
  synthetic oligo
cgcttcaaaaactccttctttgttttcttttttttctatattgatttggctcaaatgtccagtgcaatactgaatagacgtggtaaagctggcatccttatcttgttcctgatctcaggggaaaagctttcagtcttaccaaactctatcctcctacaagagactcacgtcacatgaaagaagcacatagactgaaagtgaagggattgagaaatatattctatgaaaacagaaaccaaaaagagagcaagggtatctttacccatatcagatgaaatacctgtaagtcaaaagagagcaaaggagacaaataaagtcactctataataatacggacatccattactcaagatgatttaacaattgtaagtataagtacagccaatacgagaccaccaacatgcataaaggaaatattagtagatctgaagggaaagatgaaccacaatacaataatagtaggggagtttaacacccactttcaataatggaaagatcatccagacaaaaggaacattgaacttaaactacaccttagaccaaatggacctaacagacttctacagaacattccatcggagagtaacagaaatacacgtttttctccagtgcacacagaacgttctccaggatagattggtcctatgtttggccacaagacacgtcaaaacaattgattgtgaggactgaagtcatatcaagtatgttttctgatcacaatgatatgaatctagaaaccaataattggggcaatcaggaaattcataaatatgtggaaattgacgcacgagccactgaacaacaaatgggccaaagaggaactcaaaagtgagataaagagtaccttgacacaaacaacaatggtaatacaacataccaaaacgtatgggatgaagtaaaagcctttccaagtgagaaattcatagcagcaaatgcctgtatcgagagagcaaaaatatcttaaataaaaaagctaacattacacctcaaggaactagag

SEQ ID NO: 2471 - DNA, 3000 bp, artificial
  synthetic oligo
ttttgcttgagagaagctactttctaggcacttcaacattcattcaagagagctgcctcacaagtgccctgaatgcgggaaaggattccctcataggtccaaccgttatcggcaccagccagttcacgtgtgggagacccctgtgaatgcacagtgcataacaagcgaataataagtcgcacctcacagcacctgtgaagacgttgtgataaggaaatgtatgagtgccttgagtgcaggaaaggtgtttctcctagatcaagtctgacaggacacccgaatgctttcacaggtgaaaaatctcaaggttgtcacagttgtggggaaagctttagtcagtcgacagctcttttttgcacccgagaacacacgctgaggggataccatttatatgtgatacttgcgggacaagctacagacagagatcaagtcttgttattcgcttaagaatctatacgtgggagaagccatacaaatgtaggcactgctctaaaagcttcataaagagagcagaccatatgatgcaccaagctgcacactttagagagttctctaagcatatcttgagggaaacaggtcctacagaaatgaacagttactcataaaggcctttgcttgcggtaggctgtcttggaagtagagttttcgtctacctcatttaagagaatagctttgcattttgctattaaatgttcacctacccttgccactgccctacattgcatatttttctgcctaggcagatcttgcttcatcatttcgataaaaatgtctttgtcccaagccaaccacatcataggggtaaggagtatgtaagcagtggcattcctttcagaactcaggaccatacagcaggaagcatgaggtgcccgactgatctttatctatgcaatattttaatcaagtggacaggcatatgctcttcctatttcagtctcattaccacattgtctgagcaattgaggttggagatgcttccctgaacggtggcgaaaagtatctctcttgactcctgcccccagcacgtgccaggatccctttcttcaatacaaccacagtgttctgtttgtgcatgctttgagccttcaacacagtccacctttgaagtatggactatttcgaagaaataatggcaactcataagcactacgagggacaggaaacactggccaacacatacatagcaggaagatgaaatattggtgtgcaggtgctattcacagtgagctttccaaaaatatcagcctattgtactctccttctatgttgtttgaaacgataagtgcatttaaggctatgacttgtactttaagtctagctttggtcacattccataagttatagacaatgttcttacttctgattttgcacgtttctcttttcagtttcgatttcatttcctccttgcctcaagaactggacaatgtggacatgtaccggtcaattttttgttatattgcactttgattaatagttggggttctttccatttctcctttgaagtttacttagatgttcttgaaggattatatcctaaagaccataagaaaatcaggatttgatttgtagagcgcacttgtagcatgcagtctggggactcacaattgcttttgtttcatcaggacacagagtagatggccttgctccccattctgaatgcctgcatttttgtactctccattccttcttaagaatttgctgtcatagagcaatttgtaatcttttgtcatagagtgattttgctatagagatgttctctgttacggagtaatgcttaacagttgcctaggtatgaaggtagcaatagaaaagggaggttaaattgaaaacctaggaaagaccaagcctctctaaatcaggctgacaacagtctcctccagaatcccttacttgtcttccctcctgaacatagagaggacctgtaggggtccctctaaggtttttgcaaccttgaccaccccccttacccccaccccccaccccggagtctgcagggatggttccatagtgtgccaggtatgttgtccaggctaaaatccaggaaagtaaggaatacacaggggaatcagcccccaggcggctcagcatcaggtaagggaggagagacattacactttgtccgcttgcccctgcagcacacaggccatcccgagcagaaacagtcatgggcacctccaggaaactgcacgggctttcttcttgcaacactttctcatttctagcccggtcatatgggctgaatactgccatatataaacaaagctcacccttaaacccgggccagccctctacttcttgtcctccagtcctctgtaacagatgtgaagtagaatgcatccagagctcatccctctggctctcttttgcatttacactaagctcactcagcccccacttcttggttgttaacagttgggtttgcggatgttgctggattcctttctcccatccagttgtttagtttgcatgttcagacaggacttctcggaggtctagcaagcgttggtttcacattgttaaggatcttgagtattaaaatgttacaaacatattgatatattttagataattactttcaattggcatctctaatactgaacacaagaataggaacgtataaattattgaagacgacttcaagaactaaaatgtgaggccttttaaaaagagtcagatggtatcaccaggtctgagagtggtctcttgagtcttatcagcattacattttacaaaaattcttcttcggacatctcttcccaactaggttccctcactaagaaggagagagtatgaaaggcaggcagtgaaagacaggaggcctctcatcctagtcttcagtatgagaggcgagacctccactgctctacctgctgaccctcttcggtctatcctgggcagggtgaagttcctcctcccaagatgttactctcagggcaatttcccccatgcgaaagagccctccaatgcgccaaggcaggaaagaagggtgaaggacatctg

SEQ ID NO: 2472 - DNA, 1200 bp, artificial
  synthetic oligo
agcttaggtcttgaagatggggatactaaaaagcaaatccaaagccactgtgaactgcaggcggacgaccggagtcaaaatctccaggatggtttattaaaatgcgaatccccgggttcctgtgagattcaatgcgtcagggtagcgggtggagccccgaaatacgactttttaacaagctctccctacaaattctccccacacagccaggtttaagaatcactgaccgggtcgtaacagatttaaaggtggtccccacccgctccagttactccaaggctcaaggagaagcgctcatttggatcacgacccggggttcgccccacccaacaccctgcgactaagaagcgcttaaacaggaaacgggagcccttccaaaacagcttgaggctggttggaagccaggaagagtcccagcccctcccacgtcagcatccctgtgggcgcacagcccggcgggcggcgtgtggcctgccgggagatgtagtccgtagcgcagtcccgcgcctgcgccctgggcagttgccggtgagcttgggagaaccgtgggcgctgaggcggtgagtccccgagcggccagagggcgtggccgttccctggggcgcgggcgcgggtagcggggctcctttccgtggccggggccatgctaactgggtgattccagctgtgccccgggcggcgggcgccggaaggagtggtgggcggtgggcccctatccggccagggtccccgccaccactccctgcgacccgaccgggccttcccgggagtccttctgggctgggagctcccctccaggcgtcggggcctcgtcgcccaagagcgaacaggggccgcgcccgagacactagcatccgaatttgaatcagcttttacactttttagggacgtgtcactcttgccgttcctcaagtgctctctttacacacatcgcttttcttataggccccatgagggtggattccctacgagaaggtttggagagaaatcactggtcccacagtgaaatgaacgtttctctgggaagggtccatcgaaggaaacccgaagggtcaattccctggtagacgtggtggaaggttttgggtcagtcagggaagggctgaccagctgtgaggctggcgcagattaacgggtgggtccagagccaaaaacagcacagttcctggatgccctccagcaacggttaggtgcctagac

SEQ ID NO: 2473 - DNA, 1150 bp, artificial
  synthetic oligo
aagatagcattcaaagtgggaggtacacacttatagtttccagtggagaaggttcctttcccctacgtaatggtaaattttaggtgtccactttactgtattaagggatactcagatagctggtaaagtgttgtttctggatatatctgtgagaatgtttccagaagagattggcatttgaatcagtagactgagtaaggaagatccttccttacccaatgtgggtcagcaccatccactccactgagagcccagatagaacaagaaagcaggggaaaggtgaatttgctgtctcttctgaaactgggacacccttcttctgcccttggatatcaaaactccagattttctggcctttggactttgagacgtgcaccagtgcccacccagattctcaggccttgggcctgggactgagagttacaccactggtttccctggttctgaggccttcagacttgtactgagccacaccaccagcttccctagtctccaccttgtggatggcctatcatgggaattctcagcttccataattgcatgagctaatactcctaataaataccctcccatatatctatatctatatatcttattggttctgcctctttggagaactagtataccctgctgacaatttttttaaagtaaatagggctacttttctgttactcccacatatccttacttctacaagaatcctgagggagggaggcactttgcagctgaaagggaaacagtaaaacaataagttggatgtgttgggcagatatcacatttagagaagaaaggaagtcaccctctgagcaggaggctacataggttcctttgtgcaccataaatagtcctacctctctctctactcctttcccaccatgtctctagccagcatttcctactcaatctcccttagtgaagcccttgcccagacatcaatcagtgcatcatcagaaggggaaagacccaagtaagatctgactctgataggaaagctctagtgaaagcctgtaggtctgctctttgggaatatagcagttactaggctattctgtgccacttaatgcactactaaaagtagagacacatagacattctatccagtatagcttgggatttgcaacctaatcagctctttccaagccttgacaca

SEQ ID NO: 2474 - DNA, 1000 bp, artificial
  synthetic oligo
gtgtggagggggcggcgtgtgcgggatcgtggaggtggggccgaggcagcggccgcctgagccccgctcggccttgggaacacgggggcggggcggccgcggctctgggcgacccgctgggtgcactagtgctcgggtcccaccgccctgaggctcgcgctcgagcgggtcagtcggtcggcggggcctgcgcggggcccgggcccatggcggcgtcggcggctctgtctgcagcggcggctgcggcggccctgtctggcctggcggtgcggctgtcgcgctcagctgcggcccgaggctcgtacggcgccttctgcaaggggctcacgcgcacgctgctcaccttcttcgacctggcctggcggctgcgcatgaacttcccctacttctacatcgtggcctcggtgatgcttaacgtccgcctgcaggtgcggatcgagtgagcgccggcggcggcggcggcgaaggcccggctgaaggggcgcccgtgtccccgcccgcccccggccgggtcgccggcatgaaggaaagctgggccgcggcggggggcggaggcggggcggctcggacccctggactctagacctacgccgccagggcacgacggcccagccctggccccggctgcggtctcagcccgggggccctggatcgcgcagaaacgcactgaatgggcccctgccatcgggctccagaaactacctgggctcggccgacctgttgcctcatattggccaaagagggggaaaccagaaggagggaattctgctgcggcgacttgactttccaggcccggagcagaaaggtaggaggcgacaggttggaatgggagaggggcggtggctctgcccttcagatgtcagggcgtgttggcggtcagggggaagtatggaaggcaccggggcaaaccagccagaagagctgtggagcccaggtggggaaaggaaaggcagccgcaggctctcccctcctccccagtcatgattgcaggatagggtga

SEQ ID NO: 2475 - DNA, 5850 bp, artificial
  synthetic oligo
cttcagaaaatttagatgccagaaggctgtgagctgatatattcaaagtgctaaaaatatgttgactaagaatgctatatctggcaaaattgttcctcaaatatgagggagaaattaagatattcccagataaacaaaagctaatgttaccactacacctgtcctgcaagaactgctcaagagagtactgcaaagtgaaatgaaagggtactagataggaattcaaagctgtatgaagatataaagattcccccctcctttcctcccctattccctcttctctctttttccctccctttctctcccttctccttcatccttcctcttccttcttcttccctcggatcccccctgcctctgcttccctcctctcctgtcctttcccatcctctcccctctcaacccccatctcgctcctcccacggctgtggtcacatgggggcgccgcgggatttaagcttaatctgcctggtgctcagcacagcagcctggctgtggggcgtgctgactgagctagtcttggggtcctgcagaagggggctggagggatgcccacagccaccccgccatgagcttggggctgtaggggccacaggagggccagctgacactggagacggttatccggacactggagagaagcgtcctgggccatgagaagggcttgggcacgcgggacctggcccaggaccctcagaccatcatcctacctgcccgcatcagggagattgtcacccgcaacctctcccggcctgaaagcccagtccctctgcgggccacagagatggcactgctgctgtcgctgcagaaaaagaaccagctgctgcagcaggagctgtcgcgcgcggaggacttactggcccagagccacgccaagcgtgatgagctcaccattaagcacaatgggctggagcagggtgtgcgtctggagtctgaggagctggagatgcaggagcccgggggctggtacagcagagcgtggagttgtggaggcagctgcaggaggagcctaccaggagggccaacagtggcaggcccagcttgtgcagcagctgcaggccaagattctccagtacaagaagaggtgctgggagctggagcagcagctgctggagagatccagagagcttgcgcagcagcggctgagggacacagagcacagccaagacctggagagcgccctcattcggctggaggaggagcagcagaggagtgccagcctggtccaggtgaatgccatgctccgagagcagctggaccacgcaggatcggccagccagactctgagtgaggacatatgaaaggtgaccagccactggacactcagccgcaaggagctggagcagcgggaggcggcatggaggctcgaggaggagtccttcaacgcctacttcagcaacgagcacagtcgcctgttactcctctgtaggcaggtgggggtcgggtgactggtcagcgaggtgaagatgtccaccgagagggacctgctgcagctgggaggggagctggcctggacatcatacgctgtccaggaggcgggcctggtactgagcacgggcctgcggctggcagagagcggggccgaagcggccctggagaagcaggccctgctgcaggcccaactggaggagcagctgcaggacaaggtgctccatgagaaggacatggcccagcagcagatgcaaagcgacctggacaaggccgacctcagtgccagagtgacagagctggccctggcagtggagcgtcttcagaagcagaatctgtagtaggattaggtcaagaagcccctcggcaagcctgaggccctggaatccctgcggctacaggagcaggtggccctggagacagaggatggagaggggctgcagcagaccccgagggacctcgcacaggccgtcctgttggacactgagacggcgtccagctgagcggctccgagcacactgcggacgcgtgcgaaggcagcctgcggggctctcaggccagcggatcccatccccacccaccgcagtgctcctcactgggcagcagccgttcgccccaccgaagccggtccctggctagctcagactcctccaggctcgccctgattcactctgccctgcacaagcgacagctgcaggtccaggacatgcgtgggcactatgaggcaaaccaggacctgctgggcaccctgtggaagcagcttagcgacagtgaggttgagcggcgggccctagaggaacagctccagcaccagtgggacaagaccgatggcgccgtgcaggcccaagaggacgcccagcgcgaggtacagaggctgcggaacgccaatgagctcctgagcagggagaagagcaaactggcccacagtctgcaggtggcccagcaacaggccaaggaccttctgaaggagcgtgagaagctgcaggctgcccaggaggggctgcggcgccagcgggaccgattggaggaagagcaggaggaggcggtgcaggatggtacacgggtgcgccaggagcttgagcgcagccataaacagctagagcagctggaagggaagcgctcaggcctggccaaggagctggtggaggtgagggaggcgctgagctgcaccacactgcagcgggacatgctgcaggccgagaaggccgaggtggccgaggcgctgaccaaggctgaggctggccaggtgaaactcgagctctccgtgaccaagctgagggcagaggaggcctccctgcaggactccctgtccaagctgagcgccgtcaacgagagcctggctcaggacaagttggatctgaaccgccttgtcgcccagctggaggaagaaaaggcagccctgcagggccggctgcggcaggcggagcaggaagccaccgtggcgcgggaagagcaggagcggctggaggagctgcggttggagcaggaggcggcgcggcagggcctggagggctccctgcgagtggcagaggaggtccaggaggcgctggagcagcagctccccacgctgcgccatgagcgcagccagctgcaggagcagctagcccagctctcccagcagctgagcgggcgggagcaggagctggagcaggctcggctggaggcacagtggcaggcagaggcgctagccaaggggtgcactggcctggtcatgcagctggcggccgcggagcctgaaggcaggaccctgtcagaggaggccacatgcctgcgcttggagaaggaagccctggagggcagcctgtttgaggtgcaagggcacctggttcagctcgaggcccgctgggatcagctggaagccgatgggcaggccctgctgttggccaaggagaccctgactggggagctggcgggcctgcagcagcaaataatagctacaaaggagaaagccagcctagacaaggagctgatggcccagaagctggtgcaggctgagcaggaggcccaggcctctctgagggagcagcgggcagcccatgaggaggactggcagtgagtccagcgcgaaaaggaggcagcatggcgggagctggaagccaagcgggcccagctgcagagtcagctgcagtgcgagcaggaggagctgctggcccgactggagatcgagaaggaagagctgagcgaggagattgctgccttgcagcaagagcgcgacgagggcctcctcctggccgagagcaagaagcagcaagccttgtctctgaaggggtctgaaaagactctgtcagagaagttgtcagagaagttgatgggtacgcggcacagcctggccaccatctccctggagatgcagccacagaaactagatgcccagagctggcaggagcaggaccggagcaccgtgaacgctctgatgtccaagctgagggacctatgggcccagctggaggaggctgatgtggcccacgcccaggaagtgaggaggctgcaagagcaggcccgagacctgggcaagcagcaggactcctgtcttcgagaggcagaagagcttcggacccagctgcacgtgctggaggatgcccgcgaccggcttcggcgggagctgctggaggcccagcgcaagctgcgtgagagccaggagggcctcgaggtgcagcgccaggaggcgggcaagctgtggcgcagcctgggcgagggtgccaaggagcgtgaggcactgcaggccgccgtgaagaaggcagagagcgagcgcatcagcctgaagtttaccaatgaggacaaggagcagaagctggcactcctagagggcaaggaggctggggagctttggactgggctgcaggaggtggagcgctcacggctggaggcttggagggagctgcaggagctccggcgtcagatgaagatgctggacagtgagaataccagagtgggccgcgagttggcggagctgcagggccgcctggtgctgggctagcaggcagagaaggagagccggcgggagatcctgcgcctccggcagaggctgctgaagggcgaggacagcctggaggcgacgcggcaggagctccaggtagcccagcggaagctgcaggaacaagaaggcgagttccggacccgcgagcgaggcctgctgggcttcctggaggaggtgcgcggcaccgaaaagcagcagctggaccacgcccgcggcctggagcacaagctggaggcggcgcgggccgaggctgcggagctgggcctgtggctgagcgcggccgagagccgggcacaagacctggaggccgagctggcccgcgtggaggtgcagcggtgcgcggtggaggcccagctgggcggcctgcgctcggttctgtgccggggcctcgccctgggtcgcgcgcccagcccagtccagccccgccaccaatgcccggctcccctgcccgggacgcgcccgctggaggaagcggggaaaggctaggccgccccagcaccttagaatgcagccctgggtcccagccaccatttccaggacctaccacctccccggctcctctagacctggacccagaggcagtgcgcggggccctccgggaatttctgcaggagcggcggagcgccctgagagaacaggacgaacttcggacccagagtgccctgaatcgccaactggccaagatggaggctgagagggacaccacaacctcgaaggccaggcagctgcagaaggccagagtggctacagtggctgagagtgagaaagccctgcgcagtgtggatggacggctgagccgggtccaggaggagctggcgctgcaggaggagagtgtgcggcgcagtgagcgggagcgccagggccacagtggactaggtggccgcactggagagaagcctgcaggccactgagagcgagctccgggccagtcgggagaagatcagcaagatgaaggccaacaagaggaagctggagggcgacaagtggtgcctgaaggagatgctggacgcctccgagggcctcaccgtcaagctggaactgcagcggccctcgcttgagggggagccgtagcgcagccacctgggcctgagcggccacgaggcccaagcccaggccctccagaatcggatggactccctgcagagacaggtggcagacagcgaggtgaaggcaggaatcctgcagctgacagtggagtggctgaatggggccctggccaaggtggaggaaagggaggggctcctgcacgtcaaggtgcggggcctgacagaggccctggcctagagcagcgccagcctcaacagcacccaggacaagaacctgcatctgcagaaggctctgaccgcctgtgaacatgactgccaagtgctcctggaacggctggacgctgccaggcagacattgtctgaggcagggaagcagagcagctcccttggcgagcaggt

SEQ ID NO: 2476 - DNA, 1000 bp, artificial
  synthetic oligo
acttgtttcataaaggaggacttagacatacagaaatgcttatgatattgcaagtagcagtcatttagacaagttaactaggaggaaatttgctatgctgaaaccagacacgtttttgtgtcggcctttattgattttgaaaatatcaagtctagtttgtaggaaggtgtttattgtatgagtagtttatttttgaatattttaaaatttagaatgtccattttcactaaatcccagaagtttatttttttcaagcttaaaggaaagtatgtattagccagcacatacactatcctctttgtgctttatctctggtaatccttatgagagcgccatgagttagatactgttttatgcccattttatggaaatagaatcgtagagtgcatatttaagcagccctcacaggtttatccagttggaaaagtgacagaacctaggtctgtcagatttcagagattgcacacacaaatactatatgacactgcctaccgctgtgagttcagcagagaattccttgtttatatggaaataacaaagctgatagtgtccaggataattggcatcagtttacaaaccctctgtaccccaatgttggtgattttaagtggggtcatctgtccactaaattaatcagatctcaggctggtcacacttctgaaattatacaccaagtttgtgtgtaagggtatttttccagggaaaaatatctatagatttcagcaagttatccaaagagggttaggcccactatttagcgttctctggatgataagagaatgccatggagcctacaccctttcaatggggagaatagtgtcgatttctttgccatttatgttctagtttttaatcagagtgttctagtcacacacacatagttagctatgaggaatatctgcagatgctggttcaaaggagtcagtcacttcaaatcggacacttcaaacgagtcagccaactccacctgaagaagtttatacttttggctgtgtgttta

SEQ ID NO: 2477 - DNA, 1050 bp, artificial
  synthetic oligo
ctagagtagttgctaggtcctgctcaatcagcataacgtcctcaatgcaaagaaatggtgtcacatggtgggaaggaaaggagatcaagatccctaaggactagtttgggacataagtttatgatgcaggatactttcttgaccccttcacaggactcgtgacaggggtgcccagccactttggcaccagcaggagcaaactccttttccttgggcccaccacacctcacctctcacgggatggagcatgtagacaagtgagtgtggcaactggccagctgctttggcgctggcaggagcaacctccatgcaggcactgtggcaccatctgggtaggagtgcctgcaaccccaaggccccagagtgcatgttacaatgctctgttagctccaccatccatggacagcagtgtgttatcagctcagtgggacctttgcctcattgcatggggtggctgccctctatcagcaagggcaaagggccagtgtgacagcctttttgggtactcatacttggtgcgtcccaaattcttgtctggtgcccaagaagaatgaggtcacacagactaattgaaggatggtgagtgcagagaattttgttttgcgatgaaagcagctttcaggggaaaaggcagctggaaaggggacgtgaagggcaggtcactctcccctgaagtcaaatcgcctctctgcctctctcctccgaagtcaaattgcttctgcccgacctctagctgtcatctctgaagtcaagtcacttctccttgatgtccggctgcttctcctctctagtggctgaatctggggtctttacaaacatgggacatggggcaggatgggccataggtggttttgggaaaggcaaaattcgattggtaaaaaaatattattcagaaaaaaccaattggcagggagtggccaagatgggatagaagtcctcacttcaggcttttcagcttgaaggtggggttgcaccaaggactcacccttgtctgcctagagtttctttgcctcctgcctgtatcacttagagagttgatgtaagactgag

SEQ ID NO: 2478 - DNA, 1000 bp, artificial
  synthetic oligo
acatagatgcctggtactcatcaatggaataccagctcctgccatattaataagccctgatagaacatgtgacaagatgttatgtggttgtgtttggccattctccatctgctcttcatggacattgggattgacggtagcatcgggaaaccaattgaagaagttgagctgtgaggtaagtgcatgatgtcaaccccacaggtaaagccctctgatgctcagtttctagcaaatcatataagaaagcaggggaggatatgccaggtggctatttgatgcccctcaaattgaggctaggaaaaaatatacaacaaaccatcttctaccattcatgaaaatatgcctgcttatggaaactaagtaagacagtacaactaataagcagacatacacagatccctggtactcgtggatgaaactccagttgctgccatatcaccaagctgtggtggagcagttgacaagatgttatcagtttggggttggccgttttccatcctctgttcaaaggaagaggttgagctgtgaggtaagtgcattatgacaacgccactgctatatcccactgatactcagtttctaggaaattatcccataaaactgaagaatatgccaggtggccatctgagccccctcaaattgagctcacaatagataatacaacaaaagcaccttttccccttcattacggcatgcatgcatatggaaaccaagtaggacagtacaactaataaacatacacagatccctggtactcatggatgacatactagcttctggcctattaaatagtcctggtggaacagttgacaagatgttgtcaggttgtgtttggccattttccatcttctcttaatggacattgtgagtaacactagcatctggaaaccaagtaaagaggttgagctgcaagataggtgtattttttcccaccctccccccagagggacagctatgtatgaatcagtttctagggaattatttatatcatgaaacagaa

SEQ ID NO: 2479 - DNA, 1050 bp, artificial
  synthetic oligo
gtatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccctagaaactgaggagcacatagatgtacccagaggggtgatgaaacacacatatctcacagctcaacttctcagtttgatttccagagctgtcattcatgaggtctatgtggaggggaaagaaagtggtcaaacaccaactgatggcttttactcaaaatctgtttcaccagagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaagtaagtagtataagaatgtctgttttataaaactataggaagtctctctttctatgattcagaagatattcatgttgcctgttgagtttcattctttgccagagttgagattgcacataatttatggtggttcctcttttctttgactaaagcatgtacattttttctttttcttttcttacttggttatggttaaaggagttacattcgtatgtatgtgcaggtgtcttttttattatttaggtt

SEQ ID NO: 2480 - DNA, 1050 bp, artificial
  synthetic oligo
gggtcatgatgttggcatgtaaatcacgtgatgccatgtcgctcctgaacacccatcctcaacactcctaagcactcagaaccgactgcgaagcagctttggtctgcgaggttctgcgtggcctggcctccgtcaccctctcctcacacgggccccatcatctcctgactctctctgctactgtccttcaccccgtagtgcccggtccatccccactccagcccatatccttggcctcaccgcaacctggaactccccctctgcctctgcgcaggcagctctgctttctccttcaagccctgcccaagggtacctccacagaaggctctgcccaaccagcagcagctcctggggctccctctgctgctgttgcccacaggcctgtggactgcttccttaccactagcccaacactgtatgtttcatttgctcattgtgcacgtactgtctgaccgccccatgaggatgtgagctccacaagggcagggaacgttgctctctgggctgtttactgctgatccccagctaccggcacgctgcctgccacagacgatgaataaatgagaggtgtcagacctggagtgaaaagaaagtcacttttgtgagacagaaaggaaggatgaggaaaatcatacactaaaagggattttttgttgatggagtacatatagaactttcagcagtaatggccacctctattttctcagaatatgtttgatgtagagaggaggctggttgaggtgtgtccaagttgtctggcttccagcttagtaaaacatggcagtttgtaagtgaatttgagaaatcatgatatcaagtgagacttgctgctttcaacttgtaaagcataacaagctgaaactgtcccatgagtaccagggatctgtgaatgttgctttagagttgtactgccttacttggtttccatgtctattcatagggccagaaaataagaggtggttttattgtattatgtgtcctggcctccgtttgtcaggcctgggatttctccctggtgtatcctcccatttatgaaataaataattccct

SEQ ID NO: 2481 - DNA, 1750 bp, artificial
  synthetic oligo
ggatggaccgggcactacggggtgaaggacagtagcagagagagtcaggagatgatggggcccgtgtgaggagagggtgacggaggccaggccacgcagaacctcgcagaccaaagctgcttcgcagtcggttctgagtgcttaggagtgttgaggatgggtgttcaggagcgacatggcatcacgtgatttacatgccaacatcatgacccggctgcagggttggagggtatgtgtttgatgcgggaaataatgggaaacatggaggtatctcaggagctcagtgattgatcgtggcagagtggaatagaaggagagagagagatgctggggttcaggaattttttacagtatttagagaagagaagaaaaagaaatgtagaaaaaaacaatgatggggtcgggggcggtggctcgtgcgtgtaatcccagcactttgggaggctgaggtgtgtggatcacctgagggggggagttccagaccagcctggccgacatggcgaaaccccatctctactaaacttacaaaaattagctgggtgtggtggctggtgcttgtaatcccgctactcgggaggctgcggcagaagaatcacttgaacccaggagacggagatttcagtgagccgagatcgcgccactgcactccagcctggctgagaagagcgaaactccatctcaagaaaaaaatgatagggattcaccaatacggacaagaaattaaaaaaaaaaaaaaaagattgtcggaaatggaaatcctagaaggttttcatgaagaagcgagtgaacaactgtcaaatgctgctgagaagttaatggcaatgtcagccgaaactgttaaccttgacaaggacagtttctctggaggggatgaggcaggagcatgaggaggacatgaggacaggcttacttactctttgctttggacatggcagagcctgcaataaggctgtctcctgctccttgtttccttgccaacagggccatcctctgccttttctgatacgaaggactgtcacattccctgggacgtttaaacacagtttcaggatctacagccaccttctctgttttatcggtcattgtttcctgaaaaacatcaatgaatatattctattcatgacaaaaatctaacaatcacaaaatggcaagcaatctgcatatgtgtatacaaccaagactttgaatcattaatttcacttttaatcatgagccaagatttaccaagtctcaacaaacactctgttctcaggaaaagaaacctaattttaatgtacacaaagtaaaacagaagaaagatggtataaccaaatcaatcagaatgcttgtggaataagcagctgtcatcaaccaaaaatagataaaaatattattacctatttgaagatgtataagccaatctgtattaacccttattagaaaaaatggatgtataaaccaatctgtattaacccttattatacattatattttaaattatatattatatatcatatatatttaatatataagtatttatgcttatatattcaaatagatgcataaaccaacgtgtattaacccttattaggaacccttattagaagattgatacaaaactgataacaacatctgacaaggaatttagaagaatgaaaaactacaagatcaagccaaaaatacaagccaagatcaccccgaacttagacacaaaaattccaaactaagggtgagcaaataaaatgtactagtacttaaaaaggacatacat

SEQ ID NO: 2482 - DNA, 2950 bp, artificial
  synthetic oligo
tgtaactcctttaaccataaccaagtaagaaaagaaaaagaaaaaatgtacatgctttagtcaaagaaaagaggaaccaccataaattatgtgcaatctcaactctggcaaagaatgagcctcaagaggtaacatggatatcttctgaatcatagaaagagtgacttcctacagttttataaaacagacgttcttacactacttacttcgtccaaggcatcggatttccttcactacttgacattttatatcagcattaatttcttgttggcttttgggagaggaggctattcctctgcattctaggtcatctccagagaaattgctggtaacatttcctcccacaggtgcattgctaccaggtttctgcatcatcccatctttgctgaaaccagtgaagtcatcaatctgagaatccaattggctgggtggaatagcatgtcctgtcataagctctggtgaaacagattttgagtaaaagccatcagttggtgtttgaccactttctttcccctccacataaacctcatgaatgacagatctggaaatcaaactgagaagttgagctgtgagatacgtgtgtttcatcacccctctgggtacatctatgtgctcctcagtttctagggaattatttatttcataaatgggaggatacaccagggagaaatcccaggcctgacaaacggaggccaggacacataatacaataaaaccacctcctattttctgtcgccttgaatagatatggaaaccaagtaaggcagtacaactctaaagcaacattcacagatccctggtactcatgggacagtttcagcttgttatgctttacaagttgaaagcagcaagtctcacttgatatcatgatttctcaaactcacttacaaactgccatgctttactgagctggaacccaggcaactgggatacaactcaaccggtctcctgttatatcaaacacattctgagaaaatagaggcggccattactgctaaaagttctatacgcactccaccaccaaaaagtcccttttactgtatgattttcctcatccttcctttctgtctcacaaaagtgactttcttttcactccaggtctgacacctctcatttattcatcgtctgtggcaggcagcgtgccggtagctggggatcagcagtaaacagcccagagagcaacgttccctgcccttgtggagctcacatcctcatggggcggtcagacagtacgtgcacaatgagcaaatgaaacatacagtgttgggctagtggtaaggaagcagtccacaggcctgtgggcaacagcagcagagggagccccaggagctgctgctggttgggcagagccttctgtggaggtacccttgggcagggcttgaaggaaaaagcagagctgcctgcgcagaggcagagggggagttccaggttgcggtgaggccaaggatatgggctggagtggggatggaccgggcactatggggtgaaggacagtagcagagagagtcaggagatgatggggcccgtgtgaggagagggtgacggaggccaggccacgcagaacctcgcagaccaaagctgcttcgcagtcggttctgagtgcttaggagtgttgaggatgggtgttcaggagcgacatggcatcacgtgatttacatgccaacatcatgacccggctgcagggttggagggtatgtgtttgatgcgggaaataatgggaaacatggaggtttctcaggagctcagtgattgatcgtggcagagtggaatagaaggagagagagagatgctggggttcaggaattttttacagtatttagagaagagaagaaaaagaaatgtagaaaaaaacaatgatggggtcgggggcggtggctcgtgcgtgtaatcccagcactttgggaggctgaggtgggtggatcacctgagggggggagttccagaccagcctggccgacatggcgaaaccccatctctactaaacttacaaaaattagctgggtgtggtggctggtgcttgtaatcccgctactcgggaggctgcggcagaagaatcacttgaacccaggagacggagatttcagtgagccgagatcgcgccactgcactccagcctggctgagaagagcgaaactccatctcaagaaaaaaatgatagggattcaccaatacggacaagaaattaaaaaaaaaaaaaaaaagattgtcggaaatggaaatcctagaaggttttcatgaagaagccagtaaacaactgtcaaatgctgctgagaagttaatggaaatgtcagccgaaactgttaaccttgacaaggacagtttctctggaggggatgaggcaggagcatgaggaggacgtgaggacaggcttacttactcttttctttggacatggcagagcctgcaataaggctgtctcctgctccttgtttccttgccaacagggccatcctctgccttttctgatacgaaggactgtcacattccctgggacgtttaaacacagtttcaggatctacagccaccttctctgttttatcggtcattgtttcctgaaaaacatcaatgaatatattctattcatgacaaaaatctaacaatcacaaaatggcaagcaatctgcatatgtgtatacaaccaagactttgaatcattaatttcacttttaatcatgagccaagatttaccaagtctcaacaaacactctgttctcaggaaaagaaacctaattttaatgtacacaaagtaaaacagaagaaagatggtataaccaaatcaatcagaatgcttgtggaataagcagctgtcatcaaccaaaaatagataaaaatattattacctatttgaagatgtataagccaatctgtattaacccttattagaaaaaatggatgtataaaccaatctgtattaacccttattatacattatattttaaattatatattat

SEQ ID NO: 2483 - DNA, 1200 bp, artificial
  synthetic oligo
aacccccctcggagccataggtgtgggttcagagagcttttccttgtactaagccaaactcagaagtagcagattttccagtcattagcagataagtcacagcagcacacgccaatgaggtacatgttaccaccatcagaacctaaagaggcccactattttttgtatcccctttgagtggtaggaagggtgagatgtaccaacttgctgttcacctgataagtatgatgttgacatgcctctgagcgcttgaccattaaatatttcactaagtttaaaggcccctgattttttgtgtgaattgatacttaggttgtcatgtcagtatgttaccagtgtgtctagagtagttgctaggtcctgcccaatcagcataatgtcatcaatgcaaagtaatggtgtcacatggttggagggaaaggagatcaagatccctacggattagtttgggacataagtttatgatgcaggatactttcttgaccccttcacaggactcatgacaggggtgccgagccactttggcaccagcaggagcaaactccttttcctcgggcccaccgcacaccacccctcatgggagggaatacgtaggcaagtgagtgtgggaactggccagctgctttggcactggcaggagcaaactcagtccaggctctgtggcagcatccagataggaatgcctgcgaccccaaggccccagagtgcgtgttacaatgctctcctagctctaccatccacaggcagcagtgtgttatcagctcagtgggacctttgcctcattgcttggggtggctgccctctgtcagcaagggcaaaggcccaatgcgacagcctttttgggtacccacacatggtgggtcccaaattcttgtctggtgcccaagaagaatgaggccacacagatgaattgaaggatggtgagtgcagagaattttattgtgcaataaaagcagctcgcagcagagaggggagctggaaagcgtatgggaagggcaggtcgctctcccctgaagtcaagtcgcctctctgcctctctcctccgaagtcaagttgcttctcccggacgtgcagccatcatctctgaagtcaagtcacctctccctgatgtccagctacttctcgtctctactggctgaatctggaatctttataggcgtgggaccgggagcagggcaggctgtaggtagttatggaaaa

SEQ ID NO: 2484 - DNA, 1500 bp, artificial
  synthetic oligo
cagagagcaatgttccctgcccttgtggagctcacatcctcatggggcagtcagacagtacatgtacaatgagcaaatgaaacaagcagcattgggctggtggtgcggaagcagtccacaggcctgtgggagagagcagcagagggagccccagaggctgtggctggttggacagggccttctgaggaggtgcccttgggcagggttgaaggaagaagcagagctgcctgtccagaggcagagggagagttccaggttgtggtgaggccaagggtagggactggagtggggatggaccgagcactacgaggtgaaggacagaggcagagtcaggaggagatggatgggacccactttaggagagggtgatggagggcaggccgtgcagaccagagccaggagttcaggatctgttctgagtacttaggagagttgaggacaggttttcaggaggcacagggcatgatgtgatttatgtgccaaaatgctgacctggctgcagggttagagagtatgtgttgatgggggcaagaatgggaaacatggagatagcacagtcacccagtgattgatcatggcagagtcgactagaggggtggagagaaatggtgatgtttggggattatattagacataaagttgcctagagttgctaagagattgaatgtgagagaagaataagagaaatgacagtgattgtaaggttttttttgcctgaaccactgggtaaatagtagggccaggagtgtttaggagccagcacacaacttgcaaaagcagattgtgcccaactcttcctgactcagtgttcaatgaccgcatgttgatagctcgacattagccaagtcagaattaatttacacaacatagtaatctgcaaacactacaaacaagggcttctctaccctaccaccctacacacacctgtggacagcaaattgttacagttttaccagtacatcactgtatggtgtcattaactgagttggcaagtgctgtatgtagagaaggtgttttgggagagacagttcaggagttcagtttaaacacatggaatgggttgaattttaaatgtttcttggacaagtaagtggagatgccatctctgcatttgaatttgagtctgaaagaatgaatttggaccctgatctctcaatatatacaaaaatcaactcaacgtggattaaagacttaaacataagacctgaaattgtaaaactcttacaagaaaacatagaggaaaagcttcttagcattgttctgggcaatacttttttggataagaccccaaaagcacagacaacaaaagcaaataagttctggaaacctattgtatagcatggtgactatagttaataacaatggattgtatacttgaaagttgtaagagagtatactttaaatgttctctccacaaaacaatacgtatatgacgtgatgggtacattaatttgcttgatttaatcatttaatgatatatacatatatcaaaacctcatg

SEQ ID NO: 2485 - DNA, 1200 bp, artificial
  synthetic oligo
gggatggaggtcatccaataggcatggatacaaactttcaaaatattgggctttgcctcactagaaggaaatcagcaagtgacagtataactgaaaaaagaaagcttaggggtctatattaagatgaaggaaacatctggtttttgttttctcaacttttattaattcatcagaggtgtgagtcaccagtacactcagccaatgtttccaaaatgaagtcctcattgcctccggagtggctgggaaaagtcacttcagaactaacttgagagaaagatgatggacaaagagatgtcttttttttttttttttttaagaaatgtagtgctggtcctgatacgtagaggtctttcctaaaattgcttgtgttaaaccccaattacattccttcctcggcaggaatttatttcttcacccagaaactgtaggactgatgtgctgacctaaaaaacatacattaaacgcagaacctcccctttacctacaaaggcagtccaggacaaagctggctattctatgtaacaatggagcccacagctctgctctcattacactgagctctgttctttctgacccattggtagggatgtcagtagtgcgattccaaactctgtttcataggaaaccaatgacttgattatacaaattcttccttcattccttctgtctgatctagaaagtcagaggtacatcaggcatgctgcctgcactcaaggagctcacagtctagtggtgaagatagccttgtcattagatacatggttttagagctcagcatttattagatatgtggttttagagctcagcatttctagtttgtaaatgtaatagatcaaaatggccatttttttcttgtagagaacttcatgccatcttttcattatgccctttagcaggatcaatagcttattattagatatttttggtatttctctgatttctccactgattttatgtgaacaagcagcatctgtgcatgtagtttctgtaccacgcatttggagtcacttctaaggatgaacagaagaacttacaaggtaaattaaaagcaaaagtaactggcacactgcttctatctgtgctgagccagttgccacttcctctccataaccctggtatattatagaactttttcttgttgttaggctaaggaagaaacgaaagggtagcttcaggccagtggctcacgcccgtaatccc

SEQ ID NO: 2486 - DNA, 5950 bp, artificial
  synthetic oligo
aatgctacccaaagataaccattgttaacattttagtgaggcttcttccagtctttttactctatatgcatatgcacccacacattcagaaactttggaaaattgaaatcctactgtatataagattaactctttcttgagagtgaaaggcatgagcctaatcaatgggctgagggatagaaaagaaacaggcacagaacaagatgcagaggagtaactttccaggctgcctttggaggcttggtggcctctgcatttggtttcccaggctgcttgcattcacttgttttaagcaaagaccatcttttattttttaaaattgttttgtaggcaaagggtcttgctatattgcccaggctggtttcaaacttttgggctcaagcaatcctcctgccttggtctcccaaactacagggattacaggtgagagcctccactcctggccatctttttgatttggatgctggctttttcgtgaactgaaacaaacacattcccaggttgagttcgatgctggttcctctggggactgacagtgccctgtgctcctcagctgcagagaactcctctcactacattagaattgttcatttattttatccatctcccccactagacagtaagccataggctcagacacccttgtctcaatcgtctgatttcccccagtgttaggtatactgctcagcaaaaagtagatacaggaacctaccaagaatgtgagggatgaacaaaggagcgaatgaatgaacaaaccaagatcaaacattccctttactggactagtgactgccactcattttcttctcttctgctttacccacagaagaggaaaaaatacctttttgagcattactctggtggctgtcacagaaggggtgaattctgctttcaaatgttttggcatttttttgactcacagctacacaacctgacaagatagccaactagctacttctcatgtttctgtggcatgcctcatgcactgctccatggagccgaccaaaaccgtattggctgggagatgtaaagtgccaaaaacggacctggcaaggagaaagaagaggcgatctgcttggagttgccattggtgggcacacaaacctgtgagtggctcgtgcgtgcttctccatggccatgcaagcttttgccctccctgcacttcacagggctgggagagaatggaaagtctatgtttaagatcagggtaagctcacgtctgtaatcctagcactttgggaggccaaggcgggtgtctcacctgaggtcaggagttcgagaccagcctggccaacatggtgaaacctcctctctactaaaaatacaaaaaaaaaaaaaaaaattagccaggtgtggtggtgggcacctgtaatcctagctgaggcaggagaattgcttgaacccgggaggaggaggttgcagtgagccgagatcccaccattgcactccagcttgggcaacaagagtgaaactcattctcaaaaaataaaataaaataaaataaaataaaaaacaggataagttgagaaagaagaaggtaaggagagggagaaagggagaattacaacaacagaattaaggccattgtcattttcccctttgatctgaatcgtcagctatttcccgcatgtaataataatagcggttgtctcttgttgaagcacctaatctgggccaggcacagggttaagccctttataagcatggcctcatcgaatccacagaacaactctctgagctgagtgccattgctatccctttcttgccgataaggaaggaactggggctcagagtggttcagcgaaggtccaagatcacacagctacttagcacagtgcctggcctacagtgaacaccctgtcaatggtagctgtcatggcgattattactatgattaatcataagaaatggctggtgccaccatcggctcaaagcagactgaagtctcaaggcccaaagcaggctctgaggtgcagactcccgggggcctgctcaacaggcatgaggacctcgacttccctttgtgcttcttcaagacttgggatggtggctccttgggtggtggggaaaatgatgccatacttgtgtctggctccttcttggttcccacaaatgtccttaacattttccattttctgagtggcttttgtgaaactgctctgatgtggttgacagaacttatagtgggatccaagtcaagccttcctccagaggaaagttggaagcctttaagggtcttgtcagtgctcacgtagcccacagcctcctgcctagcattggccaaggccaaggcttcccggcagtcagctctggatcacagcacactcattgattcctgcgctgtttccgggggtgggaaatcaatcccctatcggcctggcttgggcttgctgggccttttctccagggagagtttcgctggggcctctgatctgcacgtgatgctcttcatggttcaagggctgtcgtgtccaactcaagatgatttccttttccgtgttttctgcagcttttttttttcaggaccctagaaaaactttgaaacttaaaattactcgtgtgccaggaattcccacagcctccttgtgaggggtaggtgagcaccatatgctgtttatacaaaaataaatggcttccccccatgaagcacatgggcccaaatcactggctaaccccctttttaccttagcagctggagcaatggccctctggatgagaatgcgtacgcagatagaaatttggctctaaaaagccctgaacagtttgtttgtacaagagcttggtctcctagagaggcaggtggtgggcaggccagtgtccctctgtgggactagctgaagaaagcaggagaagaccaacatgcagtgctggacaattaccttgtccctccccggggcggactttcagggaggtcacctcatcttaatcaccacttccccaacatcatgagccctaggactgggtgcaaaggaggggtatctctctttttgaaattaaaatacttgaagttatcgcttcacttgggcaatagatgtctattaattcattcctcaagcaattattgagtacttactatgtgcacatctgaaattgtaccaagtgcaactccaaccacttgccccagtgctgacccaacaacaacactgggccaaaactaaaagtttggaagtgatggaggctgcaagttgacagcctgggcagctagagagtgaaagtgtcagttgctgcatttcgatgggattttattcaagcatgtattcattcattcattcattcattcattcattcattcaaccaagattcatgagtgtctactgtgtgccacatagtgtgctaggcactagggatatcagaagggagaatgccagctgtaatcaaagggaacttcagataacagtagctaacatctacagagtgtttatgtgtgccaagcaccatcatgagatggcttctctcttttaatgctcattccagcagtggcaaggaggtccagacagatggggaaactgaggctcagagattttactgacttactcaaagtcacatagccagaaagtggcagaagttaacttgcagaatccaagtgagcccaagggcctgaggttgtgttctttgctggttactacacattactgtacattactgcctgctgcagggattagctagctgcagcccacaggtcgagtccagcccattgactgtttttgtgctgcctgagagctaagactggtttttgtatttttaagtggttgtaacaaatcaaaagtatattttgtgacacatgaaaattatatgaaattcacatttcagtgaccatcaataaaattttattggaacacagccatgcccattcattcacgtcttgcctaaggctttttcactacagtggtagagtagagcagtggtgatagacctatggcccgcaaagtgaaaaatgcttactatctagccctttactgtcactgacagaaaaggaaacagatctcagcccatctctgagttcaggtggtccccagagccctgcctccctatcccagctcttcctcagcaactcagaaagaccaccggggagacttgagtgagcatttcagatgatggctgcctttgagttatttccagcacttccttcagagtctttgaggctgaaatgtttagggtggtattaggtttttcatcaaatgtttagatgaaaatgtagacagccgacttggggttatttgtgaacaaagccctaaaggcaaatcttattggtttttgctgagaggtgccaaattatctcagcctccactgggagctgcttgtggggccttatatgggcataatctcctaagccaggcttgcctcactctgcggcatggttggatccacttttaaggttatgtgtgaacatttcttgtcttcctgtttgctcaagctgtggggaacttggcttttgccacactttaagggaacataaatgctgtccactttgagcacgtttcatttgtatgtcaaagatgacaactgccttccttttggaattcttctccctttatatttgtctgtaggtggaaggaagcatttttgtaagtgctggagtcggggagatgtcgcttcattatcctagttgcttcctgggattagtgtgtctgaagagatgttgataaaggaaacatttactgtgtgtctataggcaatgaatgtgtctgaggcattccatgggcgttagcttactcaaaccttgcaaaatgccttcactcactctttcaacaggtatttattgaatgcctactaaatgccaagtcatgtggtaagccaagacagtaatggggagagctactccagactgggaaatcaggaacggtctctcagaagacatttaagatgaggtctgaaggataagaaggtgctggctgggagactcttcgtaattggattggaaatcttggtgcagacatttgagttaagagagttaatgaaagaactgcgccagcaactcagttgaccagagccccatgctgaggaacccaaggctactggggattttgttctagagacctcaaaatggaaccctaacctaggcttgccctggaaaatatagctctggtccaaaggagatcagctgagcaagtgaggctccccccactattggacaccaaattctgcaaatgtttatggggctgttctcataagcccagcactacctaggttttgggaatccagagacaaatcagagagcaaggagctcagggtctagtggaggaaataagtcatataatcaaataaatgactcgacgatgtactaggtacaacaaaagaaatatgtataagatctcaaggtagcacagaagagggggtgctgaacacacttgggaggcccagtaaacagccaagggaggctaaattttgaagagccagaagggcccttccagaacaagaaacctgcatgaccaaatgcccagagacacaaagccacatgccagaggcttcatgccactgggtctttggggaataagaagacctgttattttcgagcctgaagtacaaggtagagagtagtggacattgagatttcagcaagggcagttcagggtgagctttgggaataagtgtttcggatttgagccacactaaaggtatgtaaacacaagaaaggagatgtctgtgttaacttgccttgataatgcccctcttgttacccaatcccactggtttcaacttcatcttctgggaacctatggtatttcaaagacactgcctgatccctttctagacaaattttatgcttttggaagtggcatttccccgctaagtactttatactgttttcttacaactttgcaaagcatctgccatatggtatttctcccaagtgagagattattgcctctttattggagggggggagctgaaatgaagtcatctgtccactgaagtgacagctgcaagcagagatgtactctctaggcag

SEQ ID NO: 2487 - DNA, 1350 bp, artificial
  synthetic oligo
tcctgggttcaagcgattctcctgcctcagcctcccgagtagctggaattacaggtgcatgccacacgcctcgctaaattttgtatttttagcagagatggggttttgccatgttggccaggctggtctcgaactcctgacctcaagttatctgcctggctcaccctcccaaagtgctgggattacaaccgtgagccaccgtgcccggcctcatgattttttttttttttttttttgaggcagagtctcgctgtttcacccaggctggagtgcaatggcacgatctcggctcactgcaacctctgcctcctgggttcaagcgattctcctgcctcagcctcctgagtagctgggattacaggcacgcaccaccacgcccagctttttgtattctttagtagagacgggggtttcaccatgttggtcatgttaggtttgaactcctgaccttgtgatccacccgactcggcctcccaaagtgctggaattacaggcatgagccaccgcgcctggccggcctcatgattttaaaatgtacttctgtctagtaaaagggcctagaatcaatgacatcccaatggcagtgagcacacagcacctagttcttgtacagtagtcctcccttatctgtggtttcattttttgtggtgtcagttacccacagtcaaccacagcccaaaaatattaaatggaaaattccaggaataaacaaaccataagctttaaattgttctgagtagcatgatgaaatcttgcacagtcctgctttatccctcccaggacatgaatcatccctttgtccaggatgttcatgctgtggttactacctgcctgtgccggttatcagattgaatgatatagtttgtacagggtttggtactatctgtggtttcaggcatccactggaagtcttggaatgtagcccctgaggataagggaatgttacccaaacaccaggggtttggtctaggtactgctgctcaccacacagagaaccaatcactgagatgatgattattgccaaggaagaaggctttaattgggtgctgcagctgaggaaatgagagctcagtctcaaatccatctcccagaccaacaaaaactaggggtttatacagcaggcaagaaatgtaacaatgagtaagaaaacagaaactagggaggggccaggaagcaatcatgatgaataaggggtccgacatctcattgtctccaggtggtgatgtggtgagtttcagttctttgatacttttttttgacagagtctcattctgctacccaggctggagtgcaatggcagtatcatagctcactgcagcctccacctcccaggctcaaattatcctccca

SEQ ID NO: 2488 - DNA, 2000 bp, artificial
  synthetic oligo
ttatagtgtagtcttgcattgggggaaattgggcaagggggaccccagatctctctgtattatttcttacaaatgcatgtgaatctacaatcatcccaaaagacaaaagtttagttaaaagaaatataagtcagaccgtgtcacgccttggggttaagccactcattcaatgccctcccattgattttggaatgaagtggcctgcccatggactgcacctgcccatggactagtatgcaatccacgatctggtccctgccaacctgtccagccttactttctggtactctccccagctttcctggcgccaatcatgatcaccaccttttagttccaaagcatcaagatttggtccctccttctgacttgttttctggaaagctttttcctggctctttcatatctttcagggttcagcttaaatgtcacctcctcctttcctaatcacactatttgtacttttcctgcacaggctttatccaaatttgattattttctcacttctttattgtctgtctcccccactagattacaagctcccagggcagggtgcgtactgtctgcagacaacgctgttatcaccagagcccggcactgagcttggcacatggcgagggctcagtaaactgaatgctgagtgaatgagacgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagggagggggcccgaggcgcccccggcccgccctcctcccggtcttcggatccgagccggtcctcgggaaagagcctgccaccgcgtccccgcagccaccctctccgcgtgcccggccctctccagtggcgggggcacgtgggcgcgcggggtgcgtggcaagccgcccctctccccacgcccgtccggccgtctcccgcgcgcgcgccccgcacacagcctccgtgcagtgggcagagcccggccccgcgcgcgccccgccccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatg

SEQ ID NO: 2489 - DNA, 1300 bp, artificial
  synthetic oligo
tggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaa

SEQ ID NO: 2490 - DNA, 1550 bp, artificial
  synthetic oligo
agtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctag

SEQ ID NO: 2491 - DNA, 1450 bp, artificial
  synthetic oligo
aaattcaaactgttttttttcctctgttgtcataccaacacaacaatcaatatagaagacttctacgaccaaacgtgtggggattttcccccaacacaccaagcagctgacaccagctggttgttctctacttcaattctattctggtgttatcctctcaaaaatagcttcagatctcacaggtccccaagactgcccctcaccccagacactagtcaaaagtccaggcctccagaacttctgactaactgacttcaacttggggttcccgtgacccactctttgagcttgattaatttgctagagcagctcaaagaactcaggtaaatacttatgtgcattggtttattataaaggatactgcagaagatacgaatgaagagatgtgtaaggcgaggtaagggacaaggggaatggagcttctatgatctccctgggtgcaccaccctccaggaacctccatgtattcagctcttgggaagctctccaaacccagtcttcttgggattttatggaaacatcattatgtcagcattcctttcccaagtctcatatgaggcaagactctttctggagagggtcttaagactcacaatcagaaaggtgaagaaagattagagttccgccttggggcaggtgaaaggagggtgggagaagatcagagagattctgtttgctgaagccagcttctgaggcctagcacacctaacattataacaaaagactgtaacaagggctatgggagttatgagccaagaactgtggatgaaaacatatgtgtacacacacacacacacacacacacacacacagagacacatataacacatcaggcaccgattccattcatgagagttccaccttcatgatctaattacccctcaaaggccccgcctcctaatataatcacactggggattggacttcaacgttgaattttgggaggacacaaacattcacaacatttaactcactaaaccaaaactagagatgtctgggggtataaaacattctttttaaaaactgtgtctattatttttccttattacaaaagtaatatgtgaccactgtaaaatcttagagctttacagaaatatatatatatataacatggacggtaaaaatctctgaatacttgccttcccccaccccttcaagaactcctgttaacagcttattttattgatttttctagatttgttttcacacatttactaagagaataagattctcctctacatactgtttgacaactttcttttcatgctttgtaatacatcatgtatgccttttcaggccaatacatgcagatatagctcatttgttttaataattgtacaggattcttttatatgatatgccatgatgttttcctccaattatctagtgatggacacttgagtaatttccacttgtatgtctatttttatgcacttttgctggtaccatt

SEQ ID NO: 2492 - DNA, 1200 bp, artificial
  synthetic oligo
gacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcaggtatgtattaatcagtactcatgcaaatctagtttgaatttagaagtgaagttcctacttttgcacagtgagtaactgtgtatcttcctgtttataaatgcaatagcagtgtagtatttttgttatgagcataggctccggtttgaatcccagttctatcacgtactagctgagtaatcttgagcaagttacctaacctttctgagcctcggtttcctcatctgtaaaatgaagatgattactagatgatatagatgaaatgcttaggtgcagagtaagtatttcaataaatggtaagactactactattagagaggggacaattgaagtttgagagtagtcaaaattttttaccccatggaatagtggggaacactgcataagatgatactatgaagaaaagcatcttttgttttagaaagtgtaacagaataaaaatacatagcatatagaactggcaagaatccgtaacactattcaatgcaaaccacttacacacagatgagcaaactgaggtggggaggagtgaggggaaagagtggaatgcaagtagcacgagaacacagtgactcacagaagcttgattaagaccactgcaagagccacgtgtaccctccctctcataaatatggacagaataaaaggaatgttgccaaaacatagttccatttgattaaaaatatttttctaacctctgggaaagggggagagaggattccatttaccccttgatcggtacgcagagaactgtgccttttttagagctagtccattcagttagtttaacaatggtgctcatgagactgaagttgcatatttaatacccatgtgaaccagttacctttgctctatttgtgaccacaggctatatattcacctaacttggctcatttctcttattaatagatgtaggtaggattatcttcacataaaaaggacagcacattttggatttacttctttgactatatggttagaattcctatagagtaaaaacaattttagtt

SEQ ID NO: 2493 - DNA, 1800 bp, artificial
  synthetic oligo
ctccatgaggagattcatttagagctggttcaaaagccttagcatagccaaggcaggcatcacataagtccctgcccaaggaaatgagttctgctggccttctaacttatgaaaggcaaggattgtggtgtttcctgagtacttgttaatagtttctacatttgtttattgtgagtctcagaattactgataacttgatgcttaaaattgttcatagactaaaactaacagcaacaacaacatgtattgggtgttgactatgagccacataccacatactccatcttgcttagtccccaccatgaccttgtgaggtgtatgtgaatatgtcctaggtgctttactcaaccgatattcagtaaatagtgattgaatgaatgaatatccccattttatagatgaagaaactggatctcaaaaaggtgaaaggacttgccttaaatcacacagcagcaagtggcagatgcagtattatctccttgctctcacagtgtcataaaattatcagaaacaattccaagttaaatcaagtatacaacagtgaaaattagtcactggtgagattattttaccacacatgagttcactgtctatctgggaccagggcactatcctaaaataaaggaagggggatgcagaaggctcagaaagcaagcaaaagagcaaagaaaaatatacctttgggaaagaaggtgggggatgttctttccttgcagagagtagttgaggaaaggtggctatgccaacaggcccaagtctgcctttctaacactgtggccctgggcagagggaggtaacatggagctgagaggaagagaagggacttcctagggctccaagtaaaaggacaatggaacccagcaaagcccatgctcttaagcatgacaccagtctcccaatcttgcctgatggtacgaaccacctggggagcttgttcactgcccagatcctgctcccccacttcctgggggagtagatttggcatgagactcagttgcctcttcatgttttattctttttttttttttttttttttgagatgaagttttgctcttgttgcccaggctggagtgcaatggcgcaatctcggctcactgcaacctccgcctcctgggttcaagtgattctcctgcctcagcctcccaagtagctgggattacaggcacccgccacaatgcctggctaattttttgtatttttagtagagatggggtttccccatgttgatcaggctggtcttgaactcctgacctcaggtgatcagcccgccttggcctcccaaagtgctgggattacaggcgtgagccactgctcctggcctcatgttttattctttatataatttatattaacctcatttaaaagtgaactacatgaacctttcagtggaaatttaggttgttctgaaagatttcctatgtgaggctccagaaaaatatttgtcaaggaagggaggcagagtctcctcctgcccctccgatatggccctagtcccctcatgtgggctgtcatgcatctatgaagcaggggcatgtggagcagaagagtcatcagagccaaaagggtagtcagagagaccttggagaaagacattctggaggttagtctcacaaatgttgttcaaaagttttagtgaatttgattttatcttttggtcggtagaaatagacatactggttatatattgcttcaatggctacaaataataataacagttgatattgctaattgccagatacaggactataatatacattggagatataacagtgaataaaattgtcttggtccctgccctca

SEQ ID NO: 2494 - DNA, 1350 bp, artificial
  synthetic oligo
aggagacgaagaaagaaaacagctttgaaatgcaaaaaggtaggtttgctatttgctaatttctatgaatgcctaaaaactaaaaggaagctttaggctgatcatattgaacaacccagtgttgttgcatcagggaacttttagccctggaaataaaacaggaacacaattgtcaaattgacaccttctctggtccctgtgatttggaaagactttgtacatatatatttatgaaaaaaggatgtgttcctttaatgccgatgataccaaatctgaagaaatcccattatgttcaataccttaatagaagcaaccatacagcctgataccacctacagtggaataagaagacaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctaga

SEQ ID NO: 2495 - DNA, 1600 bp, artificial
  synthetic oligo
catgctctgcttcacctcaccacaaactttccctttctttgtaacagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattatcgttgttgtttgagtacctaaagctcccagccaggttggggaaagaggaagcatttggagggaattttcccaacctttgtgatgttttcataaactttgttctcaagctacttacattataaaatatcttggtggcagcacactttctggaagtctgtgacagcctttgatcgatgatgtgctagcctattcagtgaaaa

SEQ ID NO: 2496 - DNA, 1050 bp, artificial
  synthetic oligo
caaaaatatatatatatatatatcagtctgccacctgcccagtaaacataatagtcccaattgtatctactgaacttgatgtagtatcttaactaaagcaaattaacacacctctggtagatggtatatggctattgatttggaccaatacatttctttcatacgtgtcaggaaggaaaatcagaaactggttctattcacatgaacagacagaagtatatattcccagtcttaccccaaggctgttatttttcctgctctctcttataacttaacgggacctgaagcaactaaatactttatagaacatcatatcagtccactctattgatggtatcatgttaaccggacctgatgagcaagaagcagaagtaccctgggtgtcctaataagatgtacattctagaaagtaaaagataaacactgcaaagattcagggatgagctacatgagtgaagtttttagggatccagtggtctagggtctagggaatgctgggacattcactccaaagtgatggacaaattattgcacctttaacctcccacctttaagaaagagtccaaaggtgggactctgggtagggaagcaatatgttctacacttagaagtactgtaataacccatttattgagtgacatagaaggctactagttgtgagtggagccctggacaagaaaggcctctgtagcaagtccaagctgcagtaaatgcaatcgcaccacttgggttatacgctccaaaagattccttgatatgagacgtatctgtggtagaagaaaaatgtggactccctaagaagcccaaataggaaccgtgcggtgcagacccttaaggttctggagcaaggccatgccatctagaagcagaaagctatataccatttgaaaggagctcctggtatgctcctgggccctggtagagattgagcacttgctcttcagacttttttttttttttgaacctgagtctcactctgtcacccaggctgaagtgcaatggtgcgatctcagctcactgcaacctccgcctcccgggttccagtgattc

SEQ ID NO: 2497 - DNA, 2900 bp, artificial
  synthetic oligo
tctctcgatagcacgtgcacgctgtctctttcctgttactctcatttatctcttccactctgtttgtcactcagtctctctgtgtgtgtctctttcgctagcgcactttctctgcagggcttgcgctctcgctccctatctttctcacagtcttgcccgtctctccctcagtctctttctgatccattctgtctctctgtgtctctgcctgtcactgtgtcgctcgctagttcatgtgtgtctccgtctttccctagtgctctcttgtctctccatttctctctcagtctatttccccagcagttcatctttgtgggtccctagcgcacctgttcaatgtcgttcgctgtgtctctgcccgtctccgtgtctctccaactctcttgtttctgcgtctccctcgggttctctgggtgtctccttctgtctctcactggcacgtgtgcgcttgctctgtctttctcggaccctcttgtctctgtgtctctccgtgtggtttctgtctctccctgcctaagttctctctgcattactctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagccttgtgagataagtaccgctattatcttcattttatagagacagaagcagaagccaagaaagattaccctacttgcctaagttcaagtaaatattgcacacgttctattagccaagacattctggtctctcctaaacacatactgggtatttgttgtatatcaggactgaggaggccccctcttccctgcccccagaaggtagggaaggtgacccagaccagggatcatttgcattagatttccaagggattaggaggtgttttctaggcagggcacaaggggaaatgtgttctgtaaaaagaagatgcatggggtaaaactagggctgcaagagagacttgagttccaaaggctgggaaaacaggctgcagcatggtgagtgccaggaggttagctggttaaactgggtagagacaaatcctgaggggtcttgaatgccagtctgcagacttcggactttaccctgagatccctggaggt

SEQ ID NO: 2498 - DNA, 1450 bp, artificial
  synthetic oligo
agcatggtctagcaaggagtcccgcccctccagttcttgggttctgtaatattcgtaccgaacttcttcttttttattttttattttttttagatggagtttcgctctgtcacccatgctggagtgcagtggcgcaatctcagctcactgcaacctccgcctcctgggttcaagtgattctcctgcctcagcctctggagtaacggggattacaggcatgcactacaatgccccactattttttttttttttttttttttttttagtagagatggggattcaccattttggccaggctagtctcgaactcccaacctcaagtgatccaccagcctcagcctaccaaagtgctgggattacaggcgtgagccactgcacacagctccatactcaacttcttatatccatactactataacttccctcagtctcctcagttattggatcccgtaaaatccatacgccttgttgctttctgactttccaatgtctcttctccacatcatcccctccacactgtgccttttatcttcttgtttcctcattaatcctcccttactccccctcattcattacccatctttccatttcttaccagtaacagccagtttgggtactgcattatgcgggagttggggggtatctagcccagcaggtctgattgctacagaacaggctaagcacattctagcaactgatggagaagatgggaatctgctggatgacagtgtttccttttaacattactttgtattggccgggcgtggtggctcacgcctgtaatcccagcactttgggaggccgaggcaggtggatcacgaagtcaggagttcaagaccagcctggccaagatggtgaaaccccgtttctactaaaaatacaaaaattagccaggcgctgtggcaggcgcctataatctcagctactcgggaggctgaggcaggagaatcgcttgaacccaggcggcagaggttgcgatgagccgagatcacgccactgcactctagcctgggcgatagagtgagagtccgtctcaagaaacaaacaaacaaacaaaaaagcaaacaaacaacaaaccccattactttgtatttggcttcctatagcataggtgagtacctgttatcaaaacacgggtgcaaaagagagatgaaacagggatgcaaatgaagagaggatgaaatgaacattgcgctgtgcaaaggaaatgattcacattttcacaaattcagtggtctttttataaactatacctgtcagcagacctcactgtttgaagtaaacaagctcaaaaaccagaaaaaaagcaaacaaggctatcttttttacttggtggaaagtggtagatgttctaagtagagacgcagcataattcaatttcacaactctctgagagctgctatgtgcccaatgctgacatggtttctgctcctgtggttctcatcagccc

SEQ ID NO: 2499 - DNA, 1450 bp, artificial
  synthetic oligo
gatcatttatctggcagctttagctgtcagaaacaccaagagtgtggagaatagaaatgacaccctgatgccagctggggaaaagaaactgaccagagcagatggggtaagcctcctattacttctgcctttaggaccatgtcccattctaaccagcagcaaataatttggaaagccccagctctttgacaacacaattggcgacaagcagttgaaatgtgttagaagaggctcccgtttgggaagagaaacataactccaagtgacaatgaagtctccacagatctgagactgctcagaagaaaatccttgttgatgaatgtaggaaatgaaagtgtccgcctttctctcacctatcagcctcagggattaggggaggatgtggcgatctctctcccatcttcaaaggttgcttcaaagatcctttggagaaatatggcacaatttagacatttgacattccttatgcatactgatgctgtgacttcaaaagctctattggccaagctggttagggaggtgttatttatttacttttactgggaaatgttgttgttgttgttttctcctgcttgttttgttttcttaacctgtagaggcagtagccaaaggacacatcagaaacggcacgatggagttgttactgtgttgtgagtctggaaagactgctgaatctaaggtcctgacccacagggagcactatttttggcagtaatttctgatgcaactttgagggaaagggcagaaataaaagggaaccacagccagaggactctgtacagccagcagcatattggccgacggtgtaggtttcttctgctgtatttgagcagctctctgttcagtctttaccttggcaggtggagttttttttgtaaagggaagccttgtttagacaacatttgcacagaagctttgaattcccaaattgtgaaactctccaaagaagaaagaacatgtgcatttacatgaaaatataattgatagatttcatgtcctcctttccgtgcatattcaagtaattctctttctgggtggatttcacttgccacagcctttatttaaaacttaattcagaggaatcacagtttgttaggtcttttctttccctctggatttttctctaaacctcgaaagcagaagcattggcctgcatgtaacatagcaagtatgggatacagaaagtaataattggatatttatcataatgttgctttcccagaacactattcattaactgccccatatttaattatgctgaaattagcacaggggagtctctggctagtgtatttgcacatgctatcaattatgtcctaataaattaatttgcttttcaggattcaccagaggcactggttgggcctctgcgctcctgcttgactgttctgactttgaacaggtttattcagctgctgtctgctaagccctacagaaaagcacaatggct

SEQ ID NO: 2500 - DNA, 3650 bp, artificial
  synthetic oligo
tatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctggg

SEQ ID NO: 2501 - DNA, 4500 bp, artificial
  synthetic oligo
ctgctttttggcaagaccttggatagccttatttttaaacattttaacgcccccactttttgaagaagcagtccaagagtaaagtgaccctttagtacccccaaagaggggatgtggttggcccctttaagtgaaagcctagggaaggccacgtagaccttccggggggagcctctgggtccccaccccactcctgaaaagaggccctggcctttgggatcgctgggctttacggactagaggtggggtaggtggggaggctgcactgccaggaccccagcaacttccaactgctgctggggacaacttactgcatgggcaaggctctggggacagaggaggtggtaggagagaaagtccgtttagaggaacagatgggctcaaaagaagttttcagacaaacctgtggaatgggggtaaagaggacaagcaggactccatgcatttcccaataaaagtagggtgagtccaagtctacggcaggagaccagttactgtgaagaatgtacagaacgtacagaatgtgcagaaccaacttgtaggagcctaggtgagactggaagccagctccagattccgatttgaatgatgtgtgacgctgtctcttccctcaggtagacagcatacaccttccgagctccctggcctcggccataattgccagccgctcctctgggttgggcctaagagcagccggctcccggaccgcggtggcgcaggcgggctctgcggcgagccggggagagcgcggctgccggagaaatatgctaatggcggcctctccggcacagtcctggatttggtctaggctttctggcttggccctggaactctcagcaaggacgggtcgagtacccaagccgtggagaaagcccaggaagggcacgtgctaggatctcacacctgacccgcggcagaggctgctcgggggtcagacctggcgctggcgtttctttctgctcttccgcctgtgttcgggtagccacaggcttcccagaggcctggagctggtcgcccatatgcgcgtgagtgctcatctcccagtcacaactgttggcaaaccgactactacagccgtcgagttcacacttgaactggtttacgcctggaaatagaaacttcaacgctctcaccccatcctacggagccgctaagcaatatataagaagggtaataacgtattcgctggagacaacaaataattccccacgttaaaataactgattgttttcagaaatttattttttacataaatatataaaacgaattcacgccgatccccattgcacccagcatttgagaaattaccgagtgatctgtagctcagagacagacaccggcgtggtccgagtgttacagcaaagtctcagcacctgtaaacttgcaacactgagacaaatgaaacccctcgcgccggcatccgctggcgcacaagctcctgcggcccccgtcgcttgctctggaactcctagctctgggaccacttccctacccgcagatttcgccaaaggctattgcaaaaacccaccctttgtctcataaaactacaaagagccacacagccagaggcaggcttttcggcaggctcctcagccttccccggagataccggcgagtctcgggtgcaccaggcaggagcaagttttctccttactgggattggggtgcgcctctcttccacccggtggtcctgtgcgcaggggtgtgctgaggagactgtaaaaaagctactaaccggcagggcctgctctccacggaacaaggccacagggagaagaagaggggagcccctgggaacagaagaacacctggcagggctggggtggggattgcagctagtccatgacccaactacggtgtgaacctggacccggaagctgggctgtaagcggagctaaggtttcttctcctccctatagggctagcctaaagatgtagtcattacggaagccaccttttgggaatgaatcgggatgggcagcaatttccgaggggtgtggggtggggaagagagagcgagagcgagcctgagggtaggcgggggctagcaaaaattcggagagctgagcactcccctcgccttcggctcccataaggacccacccctgtcaacaaatggtaagtcctttggggaatgctagagaaagaaactggcaggtcagagataaaggtgcgcctgggcgctggggatggagtgggagggcagggaagggttagtggtccttgtcccgtggaaatcgtacatgtgctcggaaggcttgtgtaattggaggccaaggggtgcttgtattagtgtgcatgagaaagagacagagagacacatgagaccaagaagctgaatggacgtgtaagtcgcactggacgacaatttcaaaatgcagagtttggcttattatgcaaacgaataaatctcacacagctttcacttgttcatcccctgcagaccgtagcggtttgcactctcctggttcaagttcgaagtggaacgggaaacaaaagcaggcaacgattccagcgcggcctgaaagacggaccacaaagcctcctccctcgtctctcctccgggagccgggaagccaatgtgacgatcaaaagcttccacatcgccccggcggggcgcgccctcagccctgtcggggaggtggggaatctgcagaaatctaggtctggaggctcctgccaatttttccttgaatcagaggaaggcgcgggttatagggccctttctcccgtgggttcaccgccgggagaaccaagtttgtatttggccattcagtgccacccgcgcctgccctaaggctccgaggtccattaggccagtaatcgtcccaactggggaaatgaatggttggcctggcctgggggcaccggttccttcctgcctgtgggcgtctctagctgagcctctggttcagggctctgagctctgccaaggcccatgtcatttagtggcccctccggggtggggacggcctctctcggaagggtggggaagtccctcgaaactatgggcagggagagagaagagagaagagacccactgcttgttcaaaaccaagccctaacctaagccaggtctaggcaagacagagacacctcttacataggagtcaccggccctaactcctccccgccatagctctggagaggaggtgcatcttaaagatgatcctcggctcctggtggttgaggtgcagcgtcaggttgcacctggtcttgcctttcccggcgggcgggccaagagggcggctattgagcctcgcggatccaggccctagaggccaggaagaggagatcgcgcggccttgataagccggatcaccagcagtgaccctcgttgacgtcggggtaaccccgctaagtgaccgccacgtgagaaagtctgggccgctcacaatgcgccggcgcctcgttagggccgggcgggcgctcggggagccaggccagcagtgtccgcggcctcatcattcattcccctggacgtgctggtaaaaatgcatcaaaataggctgcggagcgcggtataaaagcacagcgggatgagctgctttccaaaaaggatctcggtgattggaccgagctcggcgtgattgacaagagcttagtttggtaaagggaagacacgcaagctttcacagcaggagcccttttctaaaatatatcacactagcctttgaaaagcgccgcacactataaggaaatagcgtttcacggcttgctttatggtgcgatgacatttctttaaaacacagcgaagatcaaaaaaaggagagagagaaataaaatgtgttgcaaacacaatgttttaattagtttattctgcgcgttgcttttaactgtcgtatacattgcgggttttcctttaattaaacagtccctctcgagcggtggcaggcgaggaaggcgaggcgctgcgccctttcgtttccttttggaaaaacgagaaggttggctggccccagagcccagctcgcaggctcctgtgccctcgcggccaggataggcagactgaggcgttggggcttcggaaagcggcgggacccgagcgccccacggaggcggagaaggaggggacgaggaggaaaggaaggggaggaggttctcccccggggaaccgaatgggaccaaggcagtgcgagtagctcgggcatggcgccaacctccaatcccctccccacgagctccagccagcagccggtgtccccccgcccccctaacccgcaccacctttccaagccctctctggtcgccagggtggtggggagcgataggcaccaggatgagccctgcggttctggccgtctcctcggctttcgggctccgatttccagctacttagccctctttggatcccaaagtagcggattctctgattcctgacccacaggaagaagagactacgcaagcatccgctcgccgaaagcgcgggcgccgcaggcgctgtcaaaagtggcgcctcaagaaagacgagagttgagctaatgggggaatgtgttgtgg

SEQ ID NO: 2502 - DNA, 1600 bp, artificial
  synthetic oligo
cccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttac

SEQ ID NO: 2503 - DNA, 1150 bp, artificial
  synthetic oligo
taatgactttctgccttcacatacccttcatttattctgcgaacatcaactcagggaaggtgacaagcaagtatctatatggctccctggaaccagcttctgcactaggaatatctggcttgtggagatatccatgtctgccccacacatagggaaggcaacttgcatctcggcaaggtgtggatggcatagaagagttcacttgcttgcttggtaaatgacagtgacacaagtcgcatgcaggcatgccaactgacttaatctttctctactttcccaatcacaatttggctttgcctatttatttttgtagataccattaaaaggaataccatagctgatgttatatcagacccaattactctagtgaactgcttctatttttttttttctttcatgctgtggcatttccttttccctgaaaacactctttcactcagtctagcaattaactgcttgaacagtataataaggaagcaattaagaggtgacagagaaaaattaacactccatttcacattaaagactaagtgagtatccttgccattgtgagttaaatgtgtctttgaaaacctgtagtttggatgtattttccttttgaataaggagcctagctccatgttttttgtctagcatcccaatctgaaaatggatgataactaattgggtgctgtctgcttaaacaggctatattaattgcagtttgttctcctgtaagtgtcaaggaaaacaaaatctttgtaatgtgtaggcataatgtacggctgccttcatttgaatatgcaggccatgtcctagtgcaaataaagcaaactcctagatgcaatgttgccatggcaggcagcatttgcataataaataacagctatcatgagactttctttatgaagttctctgttgtgttgtcagctgtaagggcctctactaaagcagccaatattgaggaagtagagtgtgttttgcttgcaaatgcaacaccccaacccaagtcactgtcaagaatacattattttagtgttgctggctaaatgggatggattgtgctaagtacgtacatggaatacatggtgagctatatcaacacacatccacaggatgacaagaatatgacttaaccccaagacatttggttggattaagtcaggaacat

SEQ ID NO: 2504 - DNA, 1250 bp, artificial
  synthetic oligo
agccggaaagcctgtaaacagaggtaaaccatgctatctttgtgcacctcctcactgcttgaggtcacttgtaattgcctgatgaccttctccatcctacttgcctaggaatctaggactgttactggtcttcttgttctgatcactctgccttaccagtagattcagagattcatagcatttccaaaactcaagtgagccacaggggtaatctggtctgattctcttccctgtcttacagataagaagactgaggcccagaggggagaaagagttggctcaaagtttcatagtgtcttaggaacagagtcagggatagatattgggactgaaagaccagtgttctttctactattacgcagctgttactaagctgatttgttgttttcaccaaatgtaatatatactttatcagctaaaccaacttcttccaacatacatctacaataagggctttcaggaatgaggcaaagggattaaatggggactactcctcaaagaaaagagtcatccttctatttagccaaccagggctgattaaatgtagtgaggaaggcgaaagaaggaggaatctaggtcttacccgcatattcacagaggacctcaaaattaaatatttgactagtcattacctgacaataatgacaacaacagcaagaacagccacatggtacttgctaggtatgagaccctattctgagccctttatagataataatacatttaatccaaatgatgttatgaactacagtgatattttaagtgcatgttaaaattgttactatgttaatattttaaacataatacaagtgttgtgactctattttggcatcacttgttttcttaatgtatcatgagcttcaaaccatgaaagaagcctggatctattgaccttggaaaaactctgccaccatctctcatctatcacccatcatctattcagctatcattcatcagccatcatccatccatccaaccatccacccaccaacccatccatccacccaaccatccatccatctgacactgctgagttcttcccataaaccaggccctgtggttgatgccagtgatatgcagatggagagaatatagtacctgtgcttgagttgttcacagtttgtttggtagaggaagaataagtatgaacagaccataaggcatggaaatcacttggaaacagtggcatagagtacagagaggaggcaccttgtccaacctgtttgcttgattgttttagagggaagtgt

SEQ ID NO: 2505 - DNA, 1250 bp, artificial
  synthetic oligo
tgtcataaggtatcaggtgtagtagaatctattaagcttactctaggaggctctacaaagcaaaactagataggcccaatggaagggtatcacaggcagacagatttgggctcaatatagaaagagaatttcctggcatttcagattgcataaaaaataaaataaaacttccttgacatcaaatcctatcctggagaatgtgcagaggaaactgaatgcaccttggcagggcaatggtagcagagtttccggcaattgtagggggaacaggctggatgacctctgaacttgtggccaacgtggagactctctgggaacatgacatggcagttgatttcttttgtctttttttggcacacaaaagttacaacggtagcctatgccatctataaatttaaaacaatatagaagggtataaagtaaaacatcaaagtcttccatttcctccaccatcccaaatccactgctcagaagtgaccactcagagtattttacatgcaaccctccagacattcatctgattacctactatgtttcaggcactgtgctgtactttacatttattgattatttaaccccaatcttcaacaatcctgtaaagtaggtacaagcatccctgttttatagatgataaaactgaggcttagagaatggtgcatggttaggacatgcgataaagccaggagttaaaacagagtcagctctgtctgattctaactctgggctcctatacataactgctgcagatgaaatggagatgggggtagacataggcaaacattactatgacggttatttcttagtgaaagatcaatgatcctgaaacttttcaaattaccaatggccatacacaacttactgaaaatcaaaatatttatcacattccagtgacttatcaggttccaggaagccaccaggaatttctgccaccctgaccctcagggatctatttccaacagcagtgaccctgatcctcagggatccaattccagaaatctggagatttctgcttgtcagaagtacttaagcccagcttttggaaattcagattattctacagcagaagatttcaactctgactacactttaaaatcacctggtgaacatctgcaaattacctaggccagacctcatctcagcagttctgaattaattggactaggagagggtgtggacactgggattttataaaaaagtctcctccaattcgtttaatgtacagccatattgagaaccactggtttaaagca

SEQ ID NO: 2506 - DNA, 1050 bp, artificial
  synthetic oligo
ctaacttgatatggtaatcatttcacaatatatacacatatcaaagcatcacattgtacactttaaatatacataattttgtcaattatatatcaataaagctgaagaattaatagataagctaactaccatgatttgatcattatacattgtacacatgtatcaaaatttcacactgtattccataaatatgtacaatgattatgtgtcaatgaaaaataataataaaactttttttaagaatgataaacgaaaacctccattttatttcagtctggggtaaaaaaaagaagataccaacattctgaaaaagtttagttaattttcttcaaatcacataaataggctataggttggccaggcctaaatcctggacttctgacacccagtaaaaccccattctgtgaactcaaatttctaatcacattggccttgaacactgaaccagactcccacagttagatgtgtatgtgagtttatattaataaataaaggatacttctttaaaacatccaagctattgccattgtccaaactggaggatggaccagaacttctcttctcctgacaatcaggcaccacttcaatctgaaatacagaaaataaaagttaaattagcacctctgtaggtataatttttcttcaaggcgatccagctcaaattaagtttattctaggtcctaactctgaagataaattgaaaaataaaactatgatttttttcaaaataactttgatacgtactagtaaaaagtgatttaagttgcctaagaaaacagatttaagatactaattagaacttattttatgtattaactctttatttatttggcattcttggaaaataaggttgattcataaaaagttaattttctagataactaaagggtattcattgaagaaccaaacatctttttaaccatagtgatttttgatggaaacctttctagaaaatattatatgcatccttgaattctttaatcaaagacacacgacataactgatccttttcctttttttttttctaagatctggggcaagctagaagat

SEQ ID NO: 2507 - DNA, 2600 bp, artificial
  synthetic oligo
aactgaagatgtttgcatggcctcctttagatttgtggatagcactgaatagggaggtatatttggaacatgtgttgtggctatctgatttgtgggaaattgccaccaagtctattttttgaataccaaaacttccactgcaaggcttagaacctactaagtcaaaactaccttgggtgcacaggaaggcgcgcacatcaattgcagcaccttgcagacttctctgaaaagctctggctgaacttcaggtctcagagttgcactctgttctgaggcagccccggtgccccagtcagaatggccccataggaacgcagccccacagcctgcagcatcctccctgctacatcaaccccaaagctgggcaacttcagcttgctaaatgtgagtgtatcacgactggcaagtgaccaagtccatgttaccccacttactccccttaatcaaaccatggcagcggccgtaaagactttgtgagttacttgtctttgcttttgtttgtccttccagacaaacaagagcttttgcctttgtagggaagcaacaagctcatggaccaagatgaaaagatgcgcttttctgggtgcaaagcccaagtcagtggcagcagctgtttccctacaactcctcccccacctgccctgccacggccctgctgctggtttccgaacctgagtgcctttttgacttggtttcctccacatgcgttatgggaaaaacaaaaacaaaaaaaaattgctttttcaacttcagggaatattacaagggaagtgcactcctcaaagaggctgggttctggtgtgtgagatgcagtgtgggaagatacactctattcccacttctccggggacgcaccaaagtgggtgagaaggggataggagacctgaaccagcaatggcagagacagtttcatactgcttcctgcactttcccacggtcctcctgcgggaccagagctcctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccgcaggacactgaggtccacggcgccgaagcggcagcttggggcatgtgcctggccgcccgccttggcgaacccaggtagggccgggcccctgccgctgccatcctcacgctggagagccgggcagggccgctactccagccagcagctgcccagctctgacccgcgcgccgccgctgggcactcaggcactgccggaggggtacagcccctggccccgctcagcccagctgcgccgcggccgccagtcctccggagcccccctagtagggacagaggcgcagaggcccgagagctccgcgcgcgcggagtccaggaacttgttaagagtttggggctctggcggagcgctctggcccccgccgctgcgagggcaactctccctgggtgcgcacacccacgcccccgcttagccaccggtggatgaaaggaggcgggggctgtggaggagggacgcaaggagctaaaagagagaatttctgcagagattcccattttcgagggacgaaaggccaacctaggctagcacttgtggtgggaggagacagcccagcctcgcactctcatggcaactcatgcaagtcttggcggtttcttagcattctggccagtatccacctgggcaaagactcggcgcaagggagttacactgtgtgagcacatgcaggtggccctgtcagggctgctgtctttgcccgaagagaatactagccctgaatagtctgagaggtcctgtgctgaagccgaaatatgtcctccgaggatgcaaacaaacacacagacatactctgatctcagtctttggatatgccaagtcccacgcccttcaggtcccaaacgccaagcctcctgtatagacacttgagctgccatctgccatgggcatgggagacttgacacgctttagagaggacacgagaaaacggaaaggcaagaggaggcaacccgtttaagaagccaaatggaaaatgaaaggagctagagctccttccttgccctgaacccaaagcactcagggactgggccgagggaagatggagctccgcagtgcctggaaggaaaagggtatgcaggacctgagggagccctgcttgtgaagcagtagctggctgaggagaggccaggggtgttagcatttaaaaaaaatgtgtgtctgaagctga

SEQ ID NO: 2508 - DNA, 1250 bp, artificial
  synthetic oligo
gtgagaaggctaaattaggcaaagctccgaatcctgggagctttccctggaacgcaaaatgtgcgcatcaggaaaccctctacaccctcggcccccagcttagagctggaatttgcgaaactttaaaaattacaaaagaaaagcgagtccagaattgccacgaggctgggcatccctcccaactaccacaaccccaccccttttcaccgccccttaaggcggggcccaaggctgttggagaagaacttgcagattcttctataaaagtcaaaaagaaggaaagggagttcagagactcttacacgagtcttccgcctcgccgcgttctcctgccagtttagagctggggacagggcccagccacaccacaggccttcccaaaggtcgcgaataggcctttactactaggcataggcgcttctcctttaccctccggagttcggattcatttcaacaaacctttgctgggaattttctttgtaccaggcactgtgccagggctggacacagcgatttcttaaaagacctccccaacagggtggtcgcaatctggttgggggatacaaacaagcgaaaatgccacgttagaatttaataatagctagagttcaaagtgctagagaaataggggagagcgacattgcatctgaaaatggggtttgggaagttttcctaaaagccctggagattaaactagcccttgaaacgtgggaaggctttagagggacctgactgagcccaaggggacaaagtccagggtagagggagaggtcggtgaaaaagcgcaggacaaactaagaaagagatcacgctgtagtggcagacgcccaggacgtgtaggtaagggcggctcgaacgaaagctaaaatctaaaactcttcaaaaacatgttacgaagtttgaacttcattctgcgatcaacgagaagcccatctcccaataaaatgcaaatgcaggagacctaaggtttgttcccaaactgtcctaactgccaagaagtaaaaccaaccgttttcaattcttcccctcttatgattccttctctgctcacagttgagcctgtatctaatgatttttaagatttatgttaaatttatatttatattaatcagatattatgatattttattgacaaaagagatctaaagttttgctctctactgctttaaagattttcaaatagagttattttctagctttctagctttaccttttttttttttttttttttgagacagtctcactctgtc

SEQ ID NO: 2509 - DNA, 1700 bp, artificial
  synthetic oligo
aattattccacaacaaaaactgcaaaattctaacttttttctctaaatcttaaaaatgattacgttagttcctccaacttttgatgttatttttagctcagtgattttttttttgtttgtttgtttttaacacagtttgctctggaattgtctgcactgaaaaaacattgcattattacaagggatttgttattgaacccaaggaaatgacgttagtgttccataccgttttagcttaattttggtattattatgatgttttaactagctagaatttttagggttttggaaattagtttttttttttccttttttttcctaaaagggactgaactttatattagaacagaaaatctcgtgtttgagcattcatttttatttccttttttctttccccttgctccttcatcttgggattttcaatagttgagagtagtccacacagaatccactctccaccccatttttcttaatgacaaaaacctttgcaagaatgaaggggggatcaataccatttctgaccgttactcttgtaatttgataagtatgaaactaaccccgaagtagtgctttgcagggacagcaggaaagttctcaatcaggactggagcactttccggagacctagtttaacaacttcaacgggcacttggggaaactgaggcccaagaagacgaggcaggcactttccctgtgattttttttcttctacaaaatactactttcgtccacggaaaacacttttctcgggcacctagtgtggggaggacattgctagggtccagactgcctgcctacccacgagggccgcgctctttccacttttattcccccggcctccccggatcggcgccctggatgtgatcgacaccatgaagttgccccataatcctctctggcaacataggatgtaaaatttgatcagctcattggatgaagccgacaagtcccaaaaatgtgtgaaaagggggctaagaggtaggcaggcgccgcgttgaggcagcgctcctgccagccccgctccgagttatcggtgctgcagccgcggcgcaagcgggggctgggaccgagctgcggggccgcagcggcggcggcgaccgaggcggcggcggcggcggcggctgggaggccgcggcgccatgggggggccgtaggagcggaccgtggggccggaagggggcatcgcggcggcgccggcggctgcggggttatctccgcggccgcgaaggcagcatccacgccgttgcgggtggctgagccggcgggcggggcggggcgtgcaccagggccgcgggcgactagcgctgtagcagttggcctcagggccccgccgcccgcgcgcccgcccgcccgcagggcggcgcacgcgaaggaggcggcggccgcagaaggaggcggggagctcggagcaggaggtgaggaggtggaggaccaagagtaggcagcagcggcggcggcggaggaggaggcggtggtggaggtgcgcggcctgaagaggaggatggaggagcagcagaaggagggcgaggccgaggtcgcggagcactggttttccaagtgggagcgccagtgcctggctgaggccgagcaggaggagcagctgccccccgagctgcaggaggaggcggctgcagagttggcagggctcaagagcgagaagcagaagctgtggcacctcttccagatctcggccaccgccg

SEQ ID NO: 2510 - DNA, 1250 bp, artificial
  synthetic oligo
aactttttgagggactgccaaactgttttctacagaaaacagaagcattttacaattctaccagaaatgtatgagagttcccatttgatacggcctggatctgtgtctccacagaatctccccttgaattgtaataatccccatgtgtcaaggacaggaccaggtggagaaaattgaatcacggtggtggtttcccccgtgctgttctcatgatggtgagtgagttcttatgagatctgatggttttataagggattcttccccctttacttggcacttctctttactgccaccatgtgaagaagggtgtgtttgcttccccttctgccatgactgtatgtttcctgaggcttccccaaccctgcagaactgtaagccaattaaacctcttttctttataaattacccagtctcgagtatttctttatagcagtgtgagaatgaactaatatagtaagttggtactgggagtggggtgctgctgtaaagatacctgaaaatgtcgaagtgactttggaactgggtaacaggcagaggttggaacagtttgaagcgcttagaagatgacaggaagatgcgggaaagttcggaacttcccagagacttgttgaatggctttgagcaaaatgctggtagtgaagtggacaatgaagtccaggctgaggtggtttcagatggagatgagaagctcattgggaactggagcaaaggtgactcttattatgctttagcaaagagactggcagcattttgcccctgccccaaagatctgtgaaattttgaacttgagagagatgatttagggtatctggcagaagaactttctaagcaacaaagtttttaagaggaggcagagcatacaagcttggaaagtttgcagactgatggtgcgatagaagagaagaacctattttctggggagaaattcaagctggctgcagaaatttgcataactaacaaggaggtgaatgttaatcaccaagaaaatggggaaaatgtgaccagggcatgtcagagaccttaatggcagcccctcccatcacaggcttagaggcctaggagggaaaaatggttttgcaggccaggcccaggacccccgtggtctgtgtagcctcaggacatggtgccctgcattccagctacttcacctccagccatggctaaaaggggccaaggtacacctcaggccattgcttcagatggtgcaagccccaagccttagcagcttacatgtggtattggctctgcag

SEQ ID NO: 2511 - DNA, 1850 bp, artificial
  synthetic oligo
acagctgaggagggggtaaaaaaacactggttctatttgttttcttcctaggccccaaacagatacactggggccgtgtggctgggcgcgaaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcaga

SEQ ID NO: 2512 - DNA, 4500 bp, artificial
  synthetic oligo
ttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacctgtacagaggcgaggtgacctgcaggaagccggggccaataaagtaatcttaaaatcgttatcagtatgcaatgctgtttgagtttttccatgtctccacaattccattcgggtccaccaggcaaggcagcgcttctcgggaaagggtgcctggaaaatcagtggacctccaggcacttccagcgtgaccaagcaaagctatcgccccaaccacagggggcgcaggatggcagggggttgggtagagcatcctggagaaaattttaaattcgaaggcagcactcagcggttccttttccactcttttatttatttctttgtttttctttttatttatcattttcttttaagagagtggaaagccgtggaatttggtgcgcagaatttctatgttctcttttcatctcttcaacgccctcattttttttttttttttttcatttcactaacctttgtcatccacctgctatgtgctgagttgtgcaccaagtacgggacggagaccctgcactttcccattccgtatcagatagtggcaatggcttgggaaagtctcaagaggactccggattcggagagaaagaaattttcgcctgatgctaccccatccccctagttgatctacggagaaatcgggcctcgcgagaagcgcaacatcttggacaaggacctggcgtgagcggggtcgctacgccccgacctgcaggggccacgctcattccccagcgcgcgcgcgctttcccacggcggcgcagagtccagctagcggagaggcggagggggaagcgcccgcgtgcctggagccctggcggtccagcgtcccggcgttgccgtctgagtggcctaaaagggaggctctggggccgctgctcgcgacggagagcggggacgcggcccaggaacagctaacgtgccgcttgctgcttgccaggtatggaggatgcctatcctcaggcagacccgtttccccgcgggctggcggccagacggcgcgacaaaatgagatctgtcgagaggtctggccgtgatggctttttggcgtctaggccgctgtcatcccaattccatttctccgaaaagcatcgccgagttaggacgtcggggctttgctaatgtgatgtttgtgtaattaacaccatctccccttgtttctgaacatatttcctcccgcagcacagaccagctttcatttgaaaaagcaacgggaagaacgtcccaataaccctttctaatgggaaaaaactgccccttttgtggaatggtttctttacaaagccaacaaccaaccttattttctagttccaatggctatccctttatgagttatattattaaagaaatccgacactaattgtgccgatttaacttgttaattagttgcaaataaactattcattagtggtaaaataaaataaaacccatgtgtctagatatcattccacattcacatattgtagtgtctgcataac

SEQ ID NO: 2513 - DNA, 1300 bp, artificial
  synthetic oligo
aggccattatttcagattggagataggaaacttaaaagaactacatggacattgggtaaaagaacatgggttgaaatttgcctggcagtagcccaaaagtaaatggtcttcgaggtgcatgtgaaggaactgtaggagggaaatgggataattcacatctccgccaataaataaatgtagccacactagcgtgggggatttgaggtgagacatcgaaaatactaagtcatggtgagggctggaagacaaaagaatgaatcacttcataggaatggctgtggggaagggcttgaaggaatcatcctctgacttccatgtgaaccgtgaacattaaacatggagaaatgaggagcggcggcagatcggtttgggatgcatcttcaggggatgctgaaacaacaacagcatttggtttgctctacacccctgtcacccctcgcccgcaagcccagggagtggtcagcagtggggctttgtgacgtcgaagccaccctagggctgccactggctgggacactgcctgtatgatcaaacaaagctcaagggtgtggctttgccttgtcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacggtaagattgttaggttttgaagtgaaggcgagggtgaaagaaagacacacagagcgggggcggctcaaacaacaacacaggaatattgcagaccattgtggaagtggggggcccgcttaatgccagagcccaccgccgcttacaacctggggtgcttgtaggtaggggtgggaggggcctgggcagtatggcttgctgcccggcaggatattgataagatgttcttatgatcaggtggtttggccctttttctggtggaatatcattgtggtgttccttagaacgctgccaagcaagatatgatagggatgtttcttcagttgggcctttgtccgccttgcggacaggtggttaggcaggatgtttctcacggcctgaacccccatgggatgtttcactttgaccaaggtctgcaaaatagcaaagaactgacaaaatggtgcagtttggactcacaggtgaccctacccacgctcctcttcttcttccccatagatccctactctgtgcttcaaccttcttcttctctggatcaaaccccttcctc

SEQ ID NO: 2514 - DNA, 1000 bp, artificial
  synthetic oligo
ctagtgaggtgttttatagagcatccttcagttgggatatgtctggtgatactcgtattattagactaacattatgagatttggggcagaatctcacagaggcaaactattttccttgtcatattatatcagggttacatgatatcgcatgacaaactgctgaggatattaggcttaatcacgtcgtcaaaccagcgtatgacaggtttctccactgtaaaggtactccttgttttccatacattgctttttcaaagcaaatcattaagtgaagccaatactaaaaagagagggggattaaacaccacttgttggattagggagtatcaacataaaatatctgaaattcttctatatggatttctctattctccattatttgttttttttccaataattaatttatatcactataaaatcccagatacttattgtatgctttggaataaaatttaatattgcctcattaattttcttcctcaaattatttcaactttggccattgtgtgctctttcagttggctcctgtgtccttttgatatgctctcatttttctgtttttaaaaatttctttactttctggtaccgtaagaagcttcaggctcatcttatgtactgcctgccctagttctagaaacagccatttcttcaggcattcctattttgtttttctctttaattagataatcatattagaaacctagacctgggtcctagctttgttggttgtcaatgggttgccattgtttttaggctctcgcagttgacaaagcaagaaaacataggtatgtgtactaggctgtgtatatcagcctatctataaatatttctgtatgtatgctacgttaaacatgactttatattgatgtcttcagctctaatccattactacatgcatcattctagttttctgcctcatttgtctacaacctttcattctaactgtgagaaactaggctcccacagtccatcatttatttgctcacttggttagctgcag

SEQ ID NO: 2515 - DNA, 1200 bp, artificial
  synthetic oligo
atctgtgtatatatgcataactgtatgcgtatgtataataaagtgattgaaatgttgtaaaagtgagttacttttaattgttaatttccctgcccccattccacccctcctcatcatcggaattggtaacggctgtacagctctgtaaatttactaaaaatgattgaatcatacactgaaaatgaatacatttggtggtatgtaaattatagctcaattgatttttttcttaaagtatttgttttattcaagttgaaatagtttttgtcttattttgtttttatctggtgtttgtttcacatagacctgacacttcggatttaatacaacattcaaattccctatcgggatgctctttcctgctttcagtaggcctgccatattctctatttcaaagttagtatcttagggaagaatcctgtgaactgcagaatgtgctctgaatatctactggtctccagttcagcgaggtgtctctgttcgtgtcctgtgacagagcacactgaaatgcagctccacctcttacaaaattttgtcctccacgcagatatatgttgctgaagttcatgttcctgccatggcctatgactgtgagatctctgtattttgtggcttcttttcatcagtcccagactaattttgatttactggttttcccaacccttaggggtctggtaaaaatatcttggctactttcttcctatcaatctggaatgaatagggttgtttagagtctgcccttaaatgcagattcaagacgtctttctcaggcgttcctaacttaatgcctgtgtggcaccttgtcgctccagagttaggctaatgtggggaatctttatgattatttccatttccccaggctactgtcagactttccctgctctgagaatactgccaaactctcctctgtagtgtgtccatacagaggaagaagccaatatacccacatctgaccactgtgccctgttttgggaaccaaaatctaaaaaccaaactatctgtctttgctttcttgttataataatcttaatatacccacccacccccttctttcaggaaataagtgggtggctctttgtcaggggaggggagctcaagctgaatacaaaaaattataaggaaaagcatgtcgatatattttaaagctattatctgcattgaatgagataattattttaatacatacctccccttctagat

SEQ ID NO: 2516 - DNA, 1150 bp, artificial
  synthetic oligo
attactcttaattccaaatcctaaaatcttcacctctacctgttccatatttccagtcactctcgtgaattagatgttttatcagcacctcaaatgcaatatgtgaaaaagtgaactcattttctttttctcctaaattatctccccttgacccttctccattcctgtcagtgatttctttagtttcccaggctagaaccttagagtctttggtgactatttcttctcatttatcctcaatatataatcttttcacttactctccttgtcattgtgttctgttttgttttgttcttctttggaatgagtctggaatttgccccttctcccattttattgtaatttagtaccagccttgagtgccttttcccattctaggcaagtggcttcaggagaggagcaaaagggaactaagggtagcatctaaagagcgaaggcaggtttcagagctgagaggtcataatgatatatctaatccaagagattcttataggagagacaccatctgagatggggccgcaagtggggcttggaggatggctaggaggtgggttccagagaggtttcctggtacttaaataggaatgtatagcattggccttaggtaaagaggaattaaggatacctgccaaaccagtttggacatatacctggactcctaatctactctccctctaatccatcctgcaatgtcttgccagactcatcttcctgaaatatctctatttcatttcattatatcattcaagaacttctaatgctttcaagaatatctgtgttccaggccttgtgttaggtgctgtgaaggacaaagaagcaaatcagattatgctctgtgctctcaaggaacacacatagtctgtgtaataagggacatatacaagtatccaaagtagaaaatcattgtccgtaaaagaggtacagataaaaagttagcatgtagatggcttctacggaagtaaacttgggaatttttttttttaagacaagttctcgctctgtcacccaggttggagtgcagtggcacaatcacggcttactgcagcctcgacttcccgggctccggcaatcctcccacctcagcctcccgagtacccaggaccacaggcgtgtgccaccacacccaactaatttttgtatatttggtaga

SEQ ID NO: 2517 - DNA, 1000 bp, artificial
  synthetic oligo
tttgaagagaaatggaactggtaggggagccagcataattttccactctttatggcactgactttgggattgacacctgcgcaggtagaggacctttttatctgataggctaagggcataaactgacctcatgacttactctttcatataaaggagacacaaaagatgcatgtgtgcatgcacacacactaccaactgtgatgatgacaacaaatttcctttgtttgctttttcttggtaactttttggtgactgtcatatgctttctttctgcatcacttccccatcgtagtagaggattatgtatgaagaacacaatgtaagaactgaatttgagacccagtgtgtatcattgtatcatgctctgtttccacattgatatttccctgacatttcattaatattgtttcattaatactgcttcaatagtattataagcacagctcattttcttctttgtctatgctggagagaatctcttggatgggtacatcaatggttctaattatgtaatcaatagtaaaccaagtcttgaggccctgtgcctcagtgtttccttctctgcaggccagtatatttagtgtttttgtagtattgggtttagatgtatgatactgctttgtatttgctgtggccatatgcaaaaaagatattactactttagcactgattgggtctcagttatttgtgtgttatcatgcatgtatttaattgagcagctactacatgcaaggagctgtgagaaatgaacatgaggccaagatattgaccttgccctcaaggaatttacagtcttgtcagagagataatccatacccacaaacaccgtaaaaagtagacagaattaagaagtatgagagctacacagagaacatgacgggaattcaaagaaagtactactcctttctttcagtgaagggtccagagtggctctgaggttcattttgaacatgacgggaattcaaagaaagtactacacctttcttgcagtgaagggtcc

SEQ ID NO: 2518 - DNA, 1000 bp, artificial
  synthetic oligo
caggctttgagaactttcctctttcagcataaggagggaggggggcagagaggcagtgagaggcatttaactgtgctgatgtgactttttaaatttgttgccactgatgccacggacgttaattcttgcagggttaattatgagaaattaaaaagctgctctgaacagactgtacctttcacactctgataaagcaggctctgacatgagaacatctcttcattaatatccatccccaaagggctactacatgcagcatttggaatatgaatcttgaacttccagggacaatgcaggacaccatggagatagggttcagagaaggatgactatgcttcttttacattttcaggaaaacactgcagtgcctgcctggaaatcacctggctggtgacatttggaaaggataatttatttatttgcttgttggtatgttatgagttttgaaatatgattttaacttcatttcatgtagacctcactgcatcagggctctcagtgtctctgtgtaattcatgcaaacaccaacaggtaggcttgcagaagccttgtaattgtttaccatttagtatgtcacccaagtggctctagggtatgcatttgtttctcaggaaaatttcaccagctccttacactaggcacttttccaccagcctaatatattatactaaatagcaatcttgttacaccaaatacattgcagaaagtaaactgtgaaaaaataccagtataaatagtgcaactctaaggcagatgctggggaaaaaataaaagccttcctatacaatatgcttaatttgtattattgtaaccggaaaggccatgttttgaaggaaactcacctagaaatggaagtaggtaaaacagtcaaatgccgtagcagtgttacctttcagcaaagataaagccctattgttcaatggattgggaactgagagcggtcacagagcagctcttcatgttagagctctgttccagaactcaagtgtagttccccctt

SEQ ID NO: 2519 - DNA, 1050 bp, artificial
  synthetic oligo
gtgctgacatccatgacccaagataagccctccataccaaaagagcactattagccaaaggccatttgctcagttggttcaggaccaaatcatccactgcttctgacccatgtagggatggcacaggggaggaggaagggtagttcagcagaggcccctctcatgcaagcattctgcctgtgctcctggcactcccagtgccccaccctgcagattacccaagcccttttcagaccaaaagataaagatccctatggaggagtggaacacccctctggctcccaatatcaaagattagatacagacaagccctgtctagagcccaccagctctagatgccagaccacaaagggctcctcagaaagcatgattctcccccactcccctggtgtgcttagcagcagacacgtggctcaccagtgtaactctacccccaccccaatgcatctaagggcagtccttcctctgctgcctgaatacagccctcagaagctggcttctccacgtgctccaggcagaagtaatggttccctcaaatcattcagtttgtacttctctgtgaaaggctgtatggaagagggaaaatcacagggacttgagagtcagagaaacctgggttagtatctttgtgaccctgagcaaatcatctcccatatctgggctacatacccaacaggttgttgccagggttaaatggcacctagcacaagtaagcacccaagaagcagtaacagttattgctatcactctgtgctgtgataaagttaatcaaggaaaagttcagaaagggaagcaatctgtgaatgtctgggagtactgaaacaggcttgcctaaggcctgagcagagccttagcttagtctgcctcttgcacaggtgaggcgcataattgcccaaaacacccctacaggagacccagcaggggttgaactccccttcctgctggccaagcctggagcctgcatcttatttgcatactgattaacactagttaggagaaatgcatgatcatgatccttgtcctgtaaaggctgggtagaaacaaagtcaa

SEQ ID NO: 2520 - DNA, 1050 bp, artificial
  synthetic oligo
atgttttcctgggcacatgaggaagttgaacaaggtgaaacagagaagttcctttatcccccatgtagggcgtgccacaggggtgtgggtcgcttcttagatgccccgctgctcaaacccctagagggagcatgcagatgggcaggtcatggggagcgctttggggctccgtcactaccatagcgtctagggtagactgttaacagctcccgaagccccagtgggtgtgtgtttcagtgtcctctttcagttttgctgtctgcaggtggcttgtgttaatcagctcaattagaccctctgctttatctcaaagacagagggctttctgtatcccggattcttgccctagtgtaccagaaaaattggaccacacatgggcttggaggatgagtgaaaggttttattgagtgatgaaaatagctctcagtgagatggatgaggaggccagaagggagatggagtgggaatgtagtcttctcttggagtcgaaccacccaatgcctggaccctcctccgactgcccccaaccgaattccatgttgccccactgttgatggcctgacggcatctgctggtgtctgtcagtgtgctcttctgctcctctgctcctctcaacgtccagctgcttgtgcatgtgcccgctagggtctcggggtttttataggcacaggatgggggcatggtgggccagagtggttttggaaaatgcaaagtttgggcacaaaaacagaagtgcttgccctcacttaggtccgtggcacaggcccaagggtgaagccatctccagggacactgcccttctctacccagcacttccctgcccccctcctgtatcaaaggcagtcttggatctcctattcagcactgaaaatgcatagaataaccataagttctcaagtttgcaaatcacatcccaggagagttccatctctccctctagactcaaactcccacacatgtcctcttctccaccttcagcatcttgcacaccactttcacttctcagttctctgccttcccaccaatgcagccaccaccacttggctacca

SEQ ID NO: 2521 - DNA, 2100 bp, artificial
  synthetic oligo
atattaagcaattatttattgttcatctgaaattcatatttaactgggcatcctgcattttatccagcagctgtattcctgcggcccacgtggtggttggcacctgccgccaatactgcttgatagagaaaatagcataatattttgcaatagtatttggggatgaatactataggctgcaagggtaacatttgtgcatttgtgtcgtttttggaagacgtttccatcatgtataaagcctgtgcctcgtggattgcaaatgagacccagttccggggggggtgggaatgagaaagcagttagaaaagaaccccaggggatctgagacccgagcttcatctgccgagtattttattctcgttaattcataacagtgtctttaaaatcctggactagaatttgagaacagtcagtgtgtgcgacagtcattactccttggagactcccactccgccagccgggcgcccttcgtgcgttcttggtgccacagcggcctccagtggttctctgaggaaccacacgctgtctccaccgccaggctccagcttgtccctaaagccagggcggaaggcggcggcgccctgtggctgcccaggggcctgggctgtgtggccggatcagagctgtaaggcacaaatccaagtgcgcgccgccgtggaaacaaagcccttccctgttgctgtgaagctcagaccagacagggttctatttcatcttccacgccaacgtgtaacgtatctgctgacccaattttacagatgttctcttcaaaacggactcggctttgtgaatatttttctctatcaagctgtggtgatagaaatgtcaaaaagcaggttggggggggcttgaaatagaatgagacactgttctgctcagaattgattcttattctatcaattggttggactggaatgaatagtgggaaaggtaaaaccactggaattaggaccccctacccctgcccagtgcctcttaccgccaacctagcaacagcctcgcttcatttcctagaaagggcggcaccagcgatccattattgaaaacacgcgactcccataaccttgttcattttcatatgtgtagctcagggcaagaggttctctgctacggcttccctttgatttgaaagcaatacaaagaataaaggaaaatcaaaactgtggccatagcaaggctgacgcttgatccttccacacacatgtgtgccccccagttactacaaaggcaattttccaaacgggtggtcgccagccttcttcctttcacaaagtgattttctggcggtttcatagctttgaggtggctcctttgcacatcatttcagctgaaatctactccctggatcgggagacccaagaagagaaaccttgtggaagcagcagtccttgcagaagactggacttggaggtgggctgaaaatagacttggtggacttggatctgaggctgcttccacttggctagctgtgtctccttggtggagctgcttgcctcctctgggctttaagctcccacctcagaataaggagctgcagtggtgcatgcctgtagtcccagcgacttgggaggctgaggtaggagaatcgcttgagcccaggaaatcgaggctagcctgggcaacatagggagatcctgtctctaaaaaagcaaaaggaaaataaacaaataaggaggtggatgagtgtccttccaactcccagtctctgattcaagctacggtacctttggtctttctcaaactctttaaagacaattattttcattcattcatttagcaaacatgtaagtgcctaaatttgccaggccctaggttagaggcttagtctagaaaaatgaataagaaatgtccccttccttagaaataggtcattgcaaagcaacgtaagaagtactagagggaagataggaactcaggttctgtgcactctgctgatgggagtgtgaatttgtgctacctctctggaggaaatttggcactaacttccagattttcaaatgcagacacttcatcaatcaggagccctggttgttttactgactagttaatttaagcagaaaaaaaaggttttttcttttttgtctgtttgtttttgaaagg

SEQ ID NO: 2522 - DNA, 1150 bp, artificial
  synthetic oligo
gcttgtgttctataaaagcaccaaaggtgacttgtgtgtatagcccctaggttggaggaaagccttgctggtttttctttttcttttttctttttctttttctttttctttttaccttgctggtttttgctggtttcattgcagcatttcagctctcctgcaacaccactgacatttctctattgtttttctcctccacactgagacctattggctcagaagtccaccagcataaaacccagattttcatacttctaaattgttttcaacatagctcaaccaggaagattgttaggcattggaggccttcctggctttcataccctggtaaacctcaccccacatgtgctaaccatagataagatggagccttgtggttagaagacccccaagacactgtctagctgctgagaaacatcacttagactcataagctccttctccaatttccatctcccccagcagttctcttgccttcctccccatttgatggtgatcccacacccataaactctagacagtcttttactctgaggatgtccccgcttctgctaccctatccaagcaccacccaataaagttgtttgtgtggtactgcccctggttggtcatagcatttttcttgatcaaccccctaatcctgcacagtgtgcaatgaactctgctgaacttggagtctcgcacttagaggttgatgattatctgagctgaggtgtgtgattttagggggtctgtttggactgttaaactgataaggccagaaggccttagaaaagcacaccaggcaggcttctcactgggacatggaatgctgctgttgtctggtcttgaagcatctcagctttcctgctgcagtagaaaactctctgactgttttggaacccagaagtcacaaattacaataggcttgtctcgactctaagctaaaacccaaaaatgtccactctgggctgtttcagactcatgtcaaggtgtgctgaacagaaagcaggcatagctcgatgcactggaggggtctttgaccctgtgatcctggtaggttttgaacacccctctctggagttagaaactgtcacaacctagatgctgtcctggactgtctgcatctcttgcagatgcccatgatgaggggattgttctctggtggggc

SEQ ID NO: 2523 - DNA, 5000 bp, artificial
  synthetic oligo
caattagcactcagcgagcaactccaggtaatttttttttttttttttttttagacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggcttcctaaaacccagcacctgctcgagtatctcctgggcacttttccagggaggcgtgttaggctgaagtctctatcatgcaagccaaagatgtcggaggggggtactggactgcaaagaaagaaaaaggatggagaccatgaagacttttttgtgcagtcagaaaattactcattttctgacacatttattgaccagcacatattctgcccaaatgctgccctctatgtgctctggtctgcgtagtctgggtacgcctggggcccatcgctagctggcatgtactgtgacgtgcggtggctgtgggggcaatggtggtgcagagctgggagatgggggaacatgaccatggaggcagcaggctgtgcagccccagcagccactagggtcaccggtacccagagatggcaaaagggcagcatgccaggtgcaggaagtcctgtggtgtccatggcaagggtactacgggacgctgtgggaagggccaccacaggcccgtaagaattcatctgagtgggagatccagggacatagaggaagggcagcgctgcaggcccagggacagcggccaccggagtgacgtgagcctggctgccctctgaccactcgccggccggctgggtcactggactgttgtcactcgccacggcggaatcaggcaccatcacaggagttgctggtggagcagagccactcctgatttgggtgttgggaccggccggttcccggtgttgcggtgtgacctggtcattctcattcggagacgtgtgatcttgttgctcagtgtctgctggtgccagacaggatccagcagcttctggcttgtcctcctcctgatgtcttggtgcagacttgacacccactcttctcttcatcctcacgaggaggtgaggggagtctctttgaaagtaaggatggcagtagaactctaactataagtcaaagtttaaataaacaaaaggaaactgcaagtcacaaggatggactacaactaccaaccatctacgcccctgtgcaagagaactctactggcccaggaggcctttctggaaaaggtcccagtccccaaaggaagctggggactcgcgttcacatcgtcaaggtttaccaagttgtggcgggcctttccgtcttggaaaaagcctcaaaatggcagattagggtgtccatggccggcggaaagggtctttgaagttgcagaccaggagggaagaagattctgggcctcccccatgcagtgtcagctggcaacagaatgcaccccggctgggttggaggccctgggtactggctcttccacaccaggggcccacctaccaagggcagcaggagcatctgcacctcctgcgccaggcgcccttcagtgcttccacttgagcacctctccagacaccagctagggtgacagtggtacaaataccagactcccctggcctgctcacctcacagggtaatgtgctgtggagtcagggggacacagcaaccgccagatgacatggctggccccggggaggacgacacgcagatacggctacttggcacctgtgatattttacacactcgagaggggcccgcaccatcctcagccctctccccacattcactcttagttcatgtcacctccacccagagggggacacaggcccacagcgatggccccacaccctgcctgaggtcgcccacttcccaggaggcagtcctgggacttccacccgaccaggccccagagcccaccgacttaacccctccagaggcttgtcgttcattaccttattcaagatggagaccagcctttttgcggagaaaatgcgggtgaaggtcctgaaagtgcattgacgccgttttcggaagccatacaagtttagctggcggaagaagctctttatcgaagttgtggcaaacactttgtgtgcgacgtcccttttgagaatctccttttcaaagagtttttgattgatcactctacaagccccactgtcatcccaccagatggacgaaaactggttgctgctgaccagtctccacagtttctgtggaaaggggagggagaggagattatcttctccctggggcgggacgtcaccgtcagggtgcggccttctgaacgaagcttcctcggccagaggttggaaagcgatttcttctgtcagcagcctcaagttagggctcccagtggaccccgggtcgtcccaggcaggggaaggatctgctgggtgaaggtaggtctctgactgcaactggggagggaaaggcaccctttccaagccatgatcctgtcctctcgaatttctttcttcacagcgagccatactcaatgatcgcttgtcctccatctggcaaacttgctagtgcagtgtggccagcagcaccccttggcagtcatgtaaccagccccatgacatcataaaggggctctgactgccggggggtggcatctccacccccagcaagttgtgtaataaagggccaaggcagacaagtagctgcccatctgcatgtgcacattctggtcctcacagtcatttcaatgggaaagatgacactagtgcacaagagtgccgaggggccctgccacaccgtagatgcagacctggagcggtccccttgtcctagagctcctgagccaggcacaactacagcaaagccctggctcaggaaggtcagagctcaccgtctgagtcatgggcccacagaccccagcacatgactgacactcggaagcacagaacaaagggtaggacggtgcccatgggtcaggctgtagccacgccaccctttccaccctgtcctagccagaggcagcaatgtgctccatacagatcctcctaacacacccacactgtcggtccccagcacgcagatgcccgacagccccttaggcaaatggcttagctgactgccccaccacacgccgtcgccatgcagtccagtggggagtcggaggcagcctccttcctgcctctcctcggcctgcacgtgtccccccaccaggcagagacccttctacaccccgggtgtctgcggtcacatcgcggtggggcatgcagctgttggccttcgagcatgttttgttttccttggccagtgtctccagagaaacgcacgtgggtttgtgtccagcggtccatctctgcaacagttgttcctttgggattggatgctaggaggtcacgggagaggtgtccatccaaagcagtgtctgtgtcacacactgtccccacacacagggccacctctgcacagactcccccgactcgattctgggcacagagctcagtgaccttccagagactgccacgaaccggtgatgcctccacgcttgagacatcctgaccgcagggcccaaggcgcactggctcagggggtgacagtgaggggtctgcaaacagactgctgatgctcaacccggccgctgccgagctgtgtgacttgggcacgtcacttaacctctctcggcctctgtctcctcccggggataagagtagtagcacctgcttcccggggctgtgaggatccagtgggacgtataggaactagcgaggcaccggcagttgggtcagagctactgttgtcacttcacaaggcattttcttcaacagcaagtcggaaatctcatgagcctaaggcagaatccacctgtggcctctggttacaacccacaggactgaaaatccttccagccacagcaactggtgaatttcctggtcaattgccacaagtcatgagctgaaccccacttgagtttcagttcaggcagaactctagagacgactagggccagctagacagcgactgcagagccttttgttgcagcgtgagcagtcctcagctgttgacatcactggggagcaaacgaggaccaggagcggtgaaaggacagtgtctgctgcagattgtcgtagcacccaaggaacactccagaaagcctcctaagcagtaacaagtgtggcaaggtgtagcccagccaacagtggcatctgcgaggcgtcccctccttcctcccactaccccgtataccctgggacctgtgcactgaaggactcatcctaaaggctgtgcccctgcagccgccagcctcactcactggctgcctgtgccagctagagatttctttcctctgaggctggctgagaggaccactccagtttcctggcccatccagcaaagaagatacacatcatgcacgtgtaaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttc

SEQ ID NO: 2524 - DNA, 4100 bp, artificial
  synthetic oligo
ggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaagtttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggtcctggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagaggccaacagggacctaggatgaatcccaggtttgggtgggagatgtggattttccatcaaaccctcccgggcctgggaagaatctgtcttgatccccattttgcagaggagggaacgggatctctgagaggttgcctgccgtgtctggttctacctcaaatggcagcgtgcactgcgagaaaagtcccggtgcaggccagcagaacaccagagttacggcatgcccttcccttagaaggtcccagaatttcctcagccctcactttcccacacaagcttctaaattggggccctcggggactcatcccttcctagacttctatccgcccccccccccactccctggtccccccccagacacacaccaaggacttctgaaatgctgagtacatacagtggtttcctcccttctgtccaaatgtggttgccatcagcgtgatcaacgagagccaaagggggacaaagatcgggatgctggagaaggcgttgtggccatccagtttgtgaaccagcagaatctaaagaaagagacatagtcccggttgatgccagcaccgaaaatgggcagaggcggaagccagacttcattaggcagttcctccccaccaccccacccccgcgtgagctcccacaagagggaacatcagcaccgccagaaaaaggcaggaaaccacctatccctggggaaagctcgaaatgagcttttatgtccctcttcagagctcggcaatagcctatccacttgaaaagttcccagtgccagcagttttatggcaaactcctccgggtgtttgttctaaggagtcaacagctcccattctagaattctccacgtgactccaatacacaaatctgacatcccactctgctttccccagagtggaaactggagccatacagaggcaccatggctaaaaaggtgcactcttctccctgccagccccacgtgctgcccccaagagaaaggaaggatgctctcctttcaccgaagctccctctcggagatggctgtgttctctcccctctcctggagtgggctcactgtgagctcgagggacagaggctgcctttctaggggtgcagaatcctgtcaggggaagcgcaagcttcaggggctgaagaggcttcccgtggaacgcttacctcaaatgtaagaaggggcacgacgatggtcatccagctcagggccatggttatgtgtgtcctgcgctgctctgcaatcacatccatagagcgcaagaacaagacggaccacacaatgtagtagaggaccaccaggcacagaaaggacatgagaatccacagcgggacacacacaacctgggggtgggtgagagaacagcaagagaagtctctttagagcttccaacctggcctctgatggaaggcatctttagcaccttgctgtgtctgtccagttaaggcggtccttcccgtgagccgaataaggaccgttccatctcccaggactgctgggagcatcgctcaggacagaaaaggtatggtatgttcactatggggcctgctgccaccaggggacacacacgctcagtgagtcatcagtccctcttcctttgggtgacagacagccctgcacctggctccgcagcctctactcttccagaggcccactctcccacactctctcaggctcctctaggttctgctgccatcacagcttcccgggaaatgggacacaactgtcaccctgtgcacacacacaagatctcaccccaacagactctcttcacaggcaacattcccacaacctgctgggggtactttggcaacacaaatgggaatgggctccccagaaagtctggctgcctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcgcacagccgttggcaggatgcagaagaggtctgtcaccctgcaaaactctccgtgctgtcccttcactatcacaccgtccccaccattagccccggcaaacactgatctgttctctgtcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagttctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtcttcatttcattttaattttgaggaagtccaaatttatgatttctctctcgtatggaccatattaacagtgccatttctaagtactctctgcctaattgcaaaccccaaaga

SEQ ID NO: 2525 - DNA, 1450 bp, artificial
  synthetic oligo
ctggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcctcatttttctaacccagttcagagcctccttggatcctgtctaaactttgtggtcacttcacacctgacctctgcctccactccaggctgccctacttacaagtaccaggttcatcttccttgggcaagtcaacatctttgagtctcagtttttctcctccgcagaatggaaatgataaaaacctcttttctaagcgtgttaggaagattcagtgag

SEQ ID NO: 2526 - DNA, 1600 bp, artificial
  synthetic oligo
atggagtgggctgggcacgtgaattaactataagtgggcataggaatcttattgtgtgatggaaatgttctaaaactaggactgtggtgatggttgcatgacctagtaactctggtaaaaaatcattgatttgtacatttcaaatgggtgaattttgtggtttgtaaattatacatcaataaagtttgaaaaaacccaacaacctaagactgggcaaccttgaagactttaactctcaagtttgtccacactgagcctccagcagttcatcagttacagtttaagttttctgcaccattactggctccaaaagtgatttctgtttctgggcttctgcttcagtaagctgtgattctctgtatccacctgtctagctctccagttttgggggcactgctttgctctgtgaccttagttctccgatgaatctgagaagagttactgatttctgctttgctcagtttctgttcctgttgtgaggatgagagtgatgacttctaagctccttatatgccagaccagaaaccagaaatttccaataaaaagatattttcttgtttaattttgaaaggtgatattaagcctctgcctggcacaacctctctggtcctccacaagcttaggccaactcaggaccccggtgtagccagccctggagggcctccacaccctgaagcatgagggacatgcctggagccagcagctttacagaagagctctggggagcaggtttctgggtgggggttatagaagctgtggctcagcatctgcagctggaagctaacaaagtgatgcattcatttgagctattatcacagaatgggcttgtgtaccttgcagctgtcatcaaaaaccatcattcttccaacagtaacttgtccacaaaccgcatttcctctttgcctctggagctgcatgaactagtagtggactagatttttgcctggattctatctctacttgtgagcaagcgttttcctttagtggaaattcctttattcatagttgccaaaaattggaagcaaccaagaggtgctcaatacgtgaatgaattaataaacggtggtacttacagacaatgaaatgttatcaataaaaataagtcaggtcgggtacgatgagtcacacctggaatcccagcactttgggataccaaggtggaaggatcgtttgtggccaggaattcaagaccagcctgagcaatatactgagaccctgtctgtacaaaaatttaagaaaatagttgagcgtggtggtgtgtgcctgtagtcacagctactcaggaggctgaggcagaaggatttcttgagcccaggagttcaaggtttattatggacagtgagctgtgatggtaccactgcactccaacctgggtgacagagcaagacactgtctgtaaacaacaacgataaaaacaaacaaataaacaaacaaacaaaaaacccacggaggaacctagtgaagaagccggtctgagaggacaacatattgtgtgattccaactgcatgactttctagaaaaggcaagctggagagacagttacaaagatcagtggttaccagagttttggaggcagcaagggagggataaataggtgaa

SEQ ID NO: 2527 - DNA, 1000 bp, artificial
  synthetic oligo
ttgattgagctcctcattcagctggtcacggtggcctggtagtgttggcctactcccttcctggagttttcctcaagcagtggtcattttgggagaggcttcttttctggaacgccatcaaagtgtttcttttcccttgctggtttgggaacctgaaaggacaacaaggagatcacagaaaggcattggttttggggaagtggatggaggagggatggaaagacgggtttcatgagaagggatacaggctggggtggggggttgtgtcaggccaggatagggtagaagtcttgggagggaggagtcaaggggaagacgaggaggagcttgggtgggttcctcaccttgatagggcttctggaccttgattgagaaggggtcttcctcctcctcgcctctttggtgttggcaggtggttgttccacaactgggctggaggcttatggtttcttggccatcttcaccttgtcctcgtctctcaatggtctactccaggccacctggcctccccatatatacccctcccaggacaatgacgaaccacatccctaagctttgactagtcagagagccactacccatccagtggtggctctggaaggcttaaatatacaaagcaccaacctgacacctctgtggtgatggtgggggaggggtggcagtgagggggccaagatgctctggttggagaaacgtagcatttcattagcaaccctatacagccatccaaactaacctgctaccctctccatctccccatattaagttctggtgggtcacatcgtggggagagagtgttccctccaagccttcccccatggccacctcattgagtggctcactccattctctcctacccttcacgattatctaatttttgtacatcttaccaaaaatccctccaaggtaatatggccgatttagctgtatgcagagatgtgaatcatcccacttccctcctaaaaatttatcctatgtaacttgaagaccactcacttct

SEQ ID NO: 2528 - DNA, 1250 bp, artificial
  synthetic oligo
tacagacagtgtcttgctctgtcacccaggttggagtgcagtggtaccatcacagctcactgtccataataaaccttgaactcctgggctcaagaaatccttctgcctcagcctcctgagtagctgtgactacaggcacacaccaccacgctcaactattttcttaaatttttgtacagacagggtctcagtatattgctcaggctggtcttgaattcctggccacaaacgatccttccaccttggtatcccaaagtgctgggattccaggtgtgactcatcgtacccgacctgacttatttttattgataacatttcattgtctgtaagtaccaccgtttattaattcattcacgtattgagcacctcttggttgcttccaatttttggcaactatgaataaaggaatttccactaaaggaaaacgcttgctcacaagtagagatagaatccaggcaaaaatctagtccactactagttcatgcagctccagaggcaaagaggaaatgcggtttgtggacaagttactgttggaagaatgatggtttttgatgacagctgcaaggtacacaagcccattctgtgataatacctcaaatgaatgcatcactttgttagcttccagctgcagatgctgagccacagcttctataacccccacccagaaacctgctccccagagctcttctgtaaagctgctggctccaggcatgtccctcatgcttcagggtgtggaggccctccagggctggctacaccggggtcctgagttggcctaagcttgtggaggaccagagaggttgtgccaggcagaggcttaatatcacctttcaaaattaaacaagaaaatatctttttattggaaatttctggtttctggtctggcatataaggagcttagaagtcatcactctcatcctcacaacaagaacagaaactgagcaaagcagaaatcagtaactcttctcagattcatcggagaactaaggtcacagagcaaagcagtgcccccaaaactggagagctagacaggtggatacagagaatcacagcttactgaagcagaagcccagaaacagaaatcacttttggagccagtaatggtgcagaaaacttaaactgtaactgatgaactgctggaggctcagtgtggacaaacttgagagttaaagtcttcaaggttgcccagtcttaggttgttgggttttttcaaactttattgatgtataatttacaaaccacaaaattca

SEQ ID NO: 2529 - DNA, 2500 bp, artificial
  synthetic oligo
agaaaaatctaaattgttgttttattctattgcttataattcagtactaccattatttatattgttgctcaaattttccagcttttgggagcccttttagtctttggaagctcctgtaccctttttatatactgcatcatttcttaagcacgtctttattttcctgcgccacaaaatgctaagctcaccttgtattttctatgccccagtcctagaaccaaataaataaataaatttggacttcctcaaaaataaaataaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggag

SEQ ID NO: 2530 - DNA, 5200 bp, artificial
  synthetic oligo
aagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacacgtgcatgatgtgtatcttctttgctggatgggccaggaaactggagtggtcctctcagccagcctcagaggaaagaaatctctagctggcacaggcagccagtgagtgaggctggcggctgcaggggcacagcctttagaatgagtccttcagtgcacaggtcccagggtatacggggtagtgggaggaaggaggggacgcctcgcagatgccactgttggctgggctacaccttgccacacttgttactgcttaggaggctttctggagtgttccttgggtgctacgacaatctgcagcagacactgtcctttcaccgctcctggtcctcgtttgctccccagtgatgtcaacagctgaggactgctcacgctgcaacaaaaggctctgcagtcgctgtctagcttgccctagtcgtctctagagttctgcctgaactgaaactcaagtggggttcagctcatgacttgtggcaattgaccaggaaattcaccagttgctgtggctggaaggattttcagtcctgtgggttgtaaccagaggccacaggtggattctgccttaggctcatgagatttccgacttgctgttgaagaaaatgccttgtgaagtgacaacagtagctctgacccaactgccggtgcctcgctagttcctatacgtcccactggatcctcacagccccgggaagcaggtgctactactcttatccccgggaggagacagaggccgagagaggttaagtgacgtgcccaagtcacacagctcggcagcggccgggttgagcatcagcagtctgtttgcagacccctcactgtcaccccctgagccagtgcgccttgggccctgcggtcaggatgtctcaagcgtggaggcatcaccggttcgtggcagtctctggaaggtcactgagctctgtgcccagaatcgagtcgggggagtctgtgcagaggtggccctgtgtgtggggacagtgtgtgacacagacactgctttggatggacacctctcccgtgacctcctagcatccaatcccaaaggaacaactgttgcagagatggaccgctggacacaaacccacgtgcgtttctctggagacactggccaaggaaaacaaaacatgctcgaaggccaacagctgcatgccccaccgcgatgtgaccgcagacacccggggtgtagaagggtctctgcctggtggggggacacgtgcaggccgaggagaggcaggaaggaggctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataaggtaatgaacgacaagcctctggaggggttaagtcggtgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcggttgctgtgtccccctgactccacagcacattaccctgtgaggtgagcaggccaggggagtctggtatttgtaccactgtcaccctagctggtgtctggagaggtgctcaagtggaagcactgaagggcgcctggcgcaggaggtgcagatgctcctgctgcccttggtaggtgggcccctggtgtggaagagccagtacccagggcctccaacccagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtcttcatggtctccatcctttttctttctttgcagtccagtacccccctccgacatctttggcttgcatgatagagacttcagcctaacacgcctccctggaaaagtgcccaggagatactcgagcaggtgctgggttttaggaagcccctcagacatcccgcctctactcattaaaaattacctggagctggccgggcgcagtggctcatgcctgtaatcccagcactttgggaggccgaggcgggtggatcacgagctcgggagatcgagactgtcctgactaacacggtgaaaccccgtctgtactaaaaatacaaaaaattagccgggcgtggcggcgggcacctgtagtcccagctactcgggaggctgaggcaggagaatggcatgaacccgggaggcggagcgtgcagcaagccgag

SEQ ID NO: 2531 - DNA, 1200 bp, artificial
  synthetic oligo
ccaaacatgcacctcaaatcacgcaccttagctccgacagtcatcagcttatacgtggctgacatcccagttcagaagagctcatttcacactgtttgggactgggggttgatcaaggaaaatgagaggatcaccagaggctgtaccatacaagcagctttattgggtggtgcttggacagggaatgcagggaggggacagactgtccagagtctatgtttccagggtcaccatcagaacggaaggaaggcaggagaactgatggtgcagatgggaattggagaaggaccttatgagtataggtgatgttgctcagcagctgggccaagtggcttgggagtctcgtaaccataaggttctatcttatctacggttagcagatgttaggtgaggactagcagggtatgcaagcgaggaaggctctgaatgcctaaaaacgtacttagctgtgccacgtttcaaaccatcaactgtgtgaaacattcagttttgtgctgatgggcttctgagccaacaggtctcagtcttgtgaagaaaaacagtagagaaacatcagcagtgctgcacgacagctgagatgctactgcaaggccctttgccagccacatcccacgtctaaacaataagcaaggccttcctccagcctaggggctacacacacaggtcatctttggttcatttatagaacacaagctgaaaactgtttttaaaatctctgaagatgtatctccacctggagaccgtctctctttttccatgtggacttcctttctccagggatcccaggaggcaagaattatcaccttcagaaacactttctgtttcccatacttgaaaagcttaacgcgaacacacacgcagagttagagagaaagagcgtgaaagccaatccaagcactagatatacactgattgagaatagtgttaatactgtaattcctcacagacaaagtttcgtacagaaggcttttaagattctgtagaaaagaaaaccagtggaaatcacgagcatccaagtatccctgtctacagcaagggaggaaagctcggtgttaagcaaagctaacactgtctcctttagaaaggctcattaactcgggggcctgtgtgaaacaacattcaggggaggccactgctgtggactagcctcctgccctaagccccagctgaccacacctgaccagaatggggtcacttgtg

SEQ ID NO: 2532 - DNA, 1200 bp, artificial
  synthetic oligo
tgagcagtgtagaacaacaatttaaaaaataataatccctccctgggcacagctgcatttgataatcctactgcctgacttgtaggccagaagcaaggaaagaaagtagccaggctgtctgtccactttcccaaactgaaactaatgtggatcgctggacacaagtcaccagcagtggacatcacagagagaaggtctaagactgatctgtcacaattgggcagagggatcacaattcctgttgggtgccctccctcaatgtgcagcttttgacagcattaccagtaaaaaatgcaacctgtctacatcaaaaatacagtgttcatgaacagctccactctcgctggccccaccagagaacaatcccctcatcatgggcatctgcaagagatgcagacagtccaggacagcatctaggttgtgacagtttctaactccagagaggggtgttcaaaacctaccaggatcacagggtcaaagacccctccagtgcatcgagctatgcctgctttctgttcagcacagcttgacatgagtctgaaacagcccagagtggacatttttgggttttagcttagagtcgagacaagcctattgtaatttgtgacttctgggttccaaaacagtcagagagttttctactgcagcaggaaagctgagatgcttcaagaccagacaacagcagcattccatgtcccagtgagaagcctgcctggtgtgcttttctaaggccttctggccttatcagtttaacagtccaaacagaccccctaaaatcacacacctcagctcagataatcatcaacctctaagtgcgagactccaagttcagcagagttcattgcacactgtgcaggattagggggttgatcaagaaaaatgctatgaccaaccaggggcagtaccacacaaacaactttattgggtggtgcttggatagggtagcagaagcggggacatcctcagagtaaaagactgtctagagtttatgggtgtgggatcaccatcaaatggggaggaaggcaagagaactgctgggggagatggaaattggagaaggagcttatgagtctaagtgatgtttctcagcagctagacagtgtcttgggggtcttctaaccacaaggctccatcttatctatggttagcacatgtggggtgaggtttaccagggtatgaaagccaggaaggcctccaatg

SEQ ID NO: 2533 - DNA, 1200 bp, artificial
  synthetic oligo
tccttgttgggatagctgaaattcttagtagaaattgcagaagaccagaggacatctgggaaatatacatggattgaagtggagaaaaataatcttttggggaaaatctccatgaccaaaaaccatcttattgttgtttttgtcttttaattgttttcactaagggggcataataatcaagtcatgtatgtaaaaggctttctaagctgtatggcagaagccctgtgcatgaccttgtcagcatcttcattgttacagattggagattggcaacctcaggagttcacaggaggagactggaactttgcttcttcccacccaagccccttttctctgtaatgggaaagtatcatttggagctgattcacacttctttgctgtgctcacttgtctcctctagagccatcagcaggggccactgctacctgcaggcagggcttgcataggtgcatgaagaggagagcagagccccttgcccttggctggcaagcttagctaagaaaattgggaagttaagtatctgtcataggatattacgagggtaacctgacagcctggaaagcacttagtgaagcacctggcccacatcagcatttggtaaatgttggccttcgctattctccttttcccctcctcctctccatcatccctctcattctcctttcccacctcaccccaccatcccgcattttcagagggctttctcaaacctcaggctaatggcttgatggactcaggaccaagctgacctggctccgacctagtggcccagtttgggtaactagattttgggccctggacccttgcattcccagcatgagcactctggggttgagatattgcctggcctttggcgcttccccttccagcccctgtgacttacgcccttccctctactctcagagctccctgatgccagtctctagctatcccaacacatttgttggatatgacttctcctttggtaatagtggcccacacagcagagattcccacttgggtgtggagtctttttgtcctcacctgccatcctacacagtgactctatacaatgacctctaattaaccaagtatttatctcagaaccttcccagcaaccctatgtagttgcacagttcattcatttatccatttattcattcaacaaacactcattgagcacctactgtgtgccctgggaggtgcaaccagggtggcaca

SEQ ID NO: 2534 - DNA, 1050 bp, artificial
  synthetic oligo
cctgctagagtcatacataaactcaaggataagaaggtggatgtcagagaaacaaggcatctcatgcctggttcaggctgggtaccaaggcatgtccaatcccttggtagcataggatgacaagagaagaaaaaagaaggtaagttctggtgaacagagtactaaaaccaaaatgtactacttgaaaagaaagtaagacataaagtaagaaagtaggtttccaccatgacagtcaacatcctggggtgggtgatggggggagcaagggcagtcacagctggagaggtgggagcacaactgaggttcagcagaggagattgtccagaaagttcagaggacagagaagagtgcagtacgaaggatggcatccctatagtttaacaaacctgcccacaagaccatcagcttgcctatattgtcaccagcatgtccccagtgtggcacaggctccagatcaatctgatattctcaaggccatggtgtccaaagttcccactgtgactgcaaaccccaaagctgccttaagcttatggagtcctttagagcctgttctggttcttattacatgtcacaaagtaggcccagactacctcccctgagggcctggaatagaaacctccatccccatccttgtatggatccaggtagagccgccatcccacagggagccatggcaggccagtggacagacttggggaaagatggcttacagaggcgcatggaaaccccacctcatactggggggtacagtgccaagaaatggcagcgggtcacaaggctggctctggcctggggagctgagaaatcctagcgtcccagagtggacaggccccatagcaccctgcccttggcctcccacccttggcaggcaatccctgacagatggttgtccagcctttccttgacctcacccccatgatgagaaattctcttctctctgagatatgtgattagaaacaggcctctctggcttcagcttccatcagccagtgagggggccctaaatatcattcagataaaatctcctccctctttctgcacatgaaaggc

SEQ ID NO: 2535 - DNA, 6100 bp, artificial
  synthetic oligo
aaagccctcaccctgcctctgtctccggcctcctctcccatttgtccatcaaccttgggataccctaggtgacaaccacaaggaaacctctttccaccagtaactgaaggaatcactctctgtacctttgtgactgcctgtaagactgccaccaatgcatgtgtgccacactgccccttggtgacatgacccgaagctggtttcatgtcattaacacaaagctctttgcctgccctctagccttcttaacctttgtttaggtcatgaaccaccttcaaatgtgatgacatctatgggccccttttccagtgggtgtgtacagtgcagtggcccccagagtttcctgaaaagttccaggaaagcagaatctactaacattcattgaacagatactccatgccaggcaccgtgctgggagctgggaagacagcagtgaacaaaacagacgctgactgctaccctcttgggatctaacctatagaggaggtcagctagcggtaagcgctaaagagaaaacaaagctgggaaggagagaggaagtgccagagatgggcgtggggctttgaaatgttacatagggtggccaggtgacatttgtgtcaagactaaaggaaatgagggagccagcccatagatatcttggggaagtgaattccagcccaagggaacagctaaagcaaaagtcctaagtaaagcaggaatgtatctatgtgttgaggaagagttgggaggtctgtgtggctggagcacagtgagtggagggaagatgacgttattgagatagtggagggacatgcctgaagggccccagaggccactagaagcacttcagttctactttgagtgcaatggggagtcactgtggggtttggcacagagatcggggaatagactgcaaggagagggttgaagggagggaggaatgagggcagtctgtgcggcagctactggagttatcctggggggagaggctgctggctggtacccggggggagcaatggatgagcagactgacattgtggatacattttgatgatgcagatggcagaattgtccactggactggctgtgaggtgtgagcaagagagaagaatcggggaggatcccagggccttctgcctgggcaacgtgaaggatggagtagccatgaactgaggtagcagactatgggctcggcacacttgggagacgatcaggaactcggttcagtcaggttatgtggagtttgcgatttctaatggccatccaggtgctggtgccaagcaggcagttagccatctcgcagacgtgtggctgtgatattacaggcttcttaggatgctctaggggaatgggcatcatttgtcccactgaggaagatgagagcaagtggtccaagggttgagtggaggtgctgggaacggaaacccaccttccatctccttggctagtgcacttggaggttgcagatagaattttaaaagcatcctgccaatgctccgtgataggcatggccatctcccattcagctttgtttaatcagatttccttcaagggactcccgcactctcgcagttctaccggggcactggcaaccctgagatgactctagctctccctggagggccttgaaggtaaggttcagtcaccagagagcaataacctcttctggctgcttgccctttgcagagcagacgggactggacccagacaaggcggattccttcacaactgccctgacgaactgtgtacccccagcctcgccctgttgggctgggcgcatcctggcagcgctggggctgcgaagccacagcccctgcatgtgcctcgcggttgggcctggacgccgctctttctccaggtaacttcgtgaaacgctaggaggcaatcgcccagcctcactgcgcctacgtagcccacgaagggatcttgctgggttctcggaggtggccccagcgctttccgagggccgagagcgtgggcgtggagggaaggaggggcctagtgggcggcgggcccacccctttattcgtggcctgcggctccgctgagcgtgaccagatgtgttggtgacaggttgctactcagaggtgcggacaggagctgagcgctgctgctgtcggagcagacgcggcgttcccgggttgtgctcagcccctgcagctgccatcggctggagaagtccaggttaggaaacgcatccggggaggggatcctagagaaggggcgcagccaaatacccgggaggtgggataggtgggaggggagtcgctggactcggcgccagggcagatggtggacagggcgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggcca

SEQ ID NO: 2536 - DNA, 1950 bp, artificial
  synthetic oligo
cctctcgtttccgtccttcttctgcaccactgactctcactcctaaagcctccaaaaagaatctttgcagaaacccaagattccttttggtttgaacttccaaggctacactagcccactcagtagggcataacctttaattactgctgtctcaattagctctgcaaattaaattctttatatttgaaccatgacttttcatggaaaacaaaaaggaacaaaccaggttagtgaggccaagagaatttccgattctgatcaaagttacatctgctccatttacaactagagtcaggagaggcagagacagcaagtgagccttttcctagtctcagaatcactcattaacattttcaaaaagtaattattatattactaaaatacatgacctccaccccaaaatcagatccaccacatattttcaaggaagggcctgtcaccttggacttacaggtcttctccctcacttccctgcattcctctctcgttttgagagtaaggcttgcgggaaagcaatactgctgtctgtgttctcagagaaattttgtcttttactaattctggcgagaaacatcacagattttatttcaaaggttagtcctgctaaaatgcaagaacagaagcctctagaggaatctctgtgttgtccaccagtcaaatgataagtaaggaagtgcctccacttgccagataaaggactggggaccaggcagatttcaaagagcccgtgggtcagagccggggcctgccctgtgcgtattctctggcagacaaggaaatgttttcctgaatgagcattcttattttgtatttaaacatgatggtacatacaagcttagttttaccattctttctaaattaagctgcaaagagctgtttggtttcgggaaactttttcttagctgttttgtgtggaactatgattagacaccgtgtaacatgcattttgaaaattcggggaccgatatctcagtgttgaaaatgttttgttttaacctctctaaattgccaggaaatgaaaccacatgggctgttgaatttgggaaacacaggcttagaacttggtattaatcttaccaagaatcaaaaaaaagtttttttttcagtttctttttcggtttctaagggccattagtgatcctccacctcaaagctatttttctttttcaaaaagcggaaatttaaaatgagctgcttgttaaatgctaaccttttaaatgtcaacattttttttctattaaaagttaaagaataagtgagacgacactttcaaatgaaggtgactttacattgttcccctggaggaatgagccatcagttagtgtggtcaaccccaaaacttacggggatgcacaaggccgcctacttaagatgcatcagtagtagagatcaatagatacaatttttttcattgcttagtaactggcttatgaaagctgaagaggcaatcattttcagaaacctcctgtcaagttttttgttttgttttttgtttgttttgtcttaacatatctgaagagaaacaaggaaacttgctgaagttaggacacccaaaatgagcccttttaaaaatgaagtgcacaaattattttatgctaagttaattaagacaacctacttatttgtcactgtaaagcaaggcaaggaatctcattgcgcttttcaaagaacgtaagaggacagaaataaatcattgtgtcgtgctgctttaagctgtatctccttatgaatacctacaaacccaaaacacagaacaccatatggagcgagcagtccagttttgcgcacacaacaaacatgaaagagaagtgctgtcgctctactactactatgtccccaggtgaaaagttcgcaaaatgtaaacaagatctagagcagatgaaactcacggtagacttgctccattcagctgtggccctaacacctacagccagcactgtcactgagtgc

SEQ ID NO: 2537 - DNA, 1200 bp, artificial
  synthetic oligo
cttggtgtgctcgtcagggtaccagggctcttagcagccacccatttgcgttttgcagcttttgctgacatggatatcaagtatgaagttattttaattgcctttggctgaaaaaaatgggtcatatgttcaatatgttcaattctggtgaaatccctgtcttctaaagcatgatagaaaggggaggtcccacccacacacaagtcctaaaatcttggggccctagtggggtatagttcaacaagggctgcagctcaggacgtggttgttgtgagatttactcgtgactgtttggttttgcactcaccatttggttttgcagattcctcagcgtgttcacacacacatacctacaaaccagtttagagttgtgtgctccattgtggggggtggtcactggggtggggtggggtagggtgggatcaggcttggtcaaagtcattgctgatgaaccagctatctgacttagctttgttcccattttcaacaagacagtgatttctcaagccaggggagtcttcacatgagatccatggatgggtattaagtggtccagaaaacccccccaaattagatgtaaaatgttggtgggctggaaagggggagacaccataagtgctttttctgtggagagaaaccatagcttataactggttctcaaagaagtctatgacccaagacaagctaagatcacaaagctgtttggtttcgttccaccaaagcagttggtgggtataaccacaacacccagatgacccagctagacactcagggcagtgacaagatcagtcagaaccattttgtggccaagcagctgatggattgttcaatcggttgttgtagactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacaggtaagtcacttccccctgagcctcgctttcctcatctgtcaacggggcacagtcccctgctcagcctgcccgcctgcctcacagggttgttgggaggaacacaggaggtgaca

SEQ ID NO: 2538 - DNA, 2600 bp, artificial
  synthetic oligo
tctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcctctatgtttttatttttcaagggagtattcagtacctacaaacccaagtcaggaagcctgctagtggctttggttctttcagaggctgctcgatgccttgtgtgtcagaaagaaagattcagcagttttgcatcatggcaaagaagcctgttattttggggctcagcccctcattttatagaggatgaaacagagggggatgggaggtcacaaagacaactgccccgggagcaggtgtgggggagacttgccctgagggtctagacgctctgcaccaccgtcctgtctcccttgctgaagaccacacatgcccttctttgaccagaccctgccacctgataggccaggacctggtaggcgggtacccaggtttcatggatggaaccacatctccccaaaagtggggaggtagctactgggatgcacgcctcccgccatgtgctataggagagcagctgaagcaacagttgggatcagatgtagtcacaattgaatgcatcatcacatttatccctctaagtggctgggagagttgatatcctcatccctaaggtacaaaatgttccaatttgatcagtggctttcaggagctgagaaaggcatgtgctctgaggcagagctgttatgtcccgcagagcctaaaaatgctctaagaacatgctccctgccaaaattctcaatggctgtgacaagggacaacgatcgaccaatgggggtggaagcagacctccgcagtccaggggccagagctaggacagaggggtcggagaaagagtcattttcccaacactccagctcttggccagtcctcacacagtcccctcctgcttcctgctgagagagatatcctcataggtctgggtaaagtccttcagtcagctttcattccctgtcaccaactttgtctctgttctccctgcccgtctcaggcagcactcctcaggaaacctctccaagagccagcctcactgcagcgcccactattgtccctctgcctcaagtgtcccatccatgccaggccccaggcaggctgcagctttccctcagggccacaccaaagcacttgggctcagctgtgctgtccccctccatcactgagctcaggggcagcaggggtggggtgccaggaggcccattcacccttctctggctctgtgttggacccacctgcccagccactgctgcttagaacctacccgctgggaaaatgaagccctcccggaggggccacctcaacctgagagcctcacggatcacagttgtccccactcagctctgccagccctcagagacccatagata

SEQ ID NO: 2539 - DNA, 1050 bp, artificial
  synthetic oligo
acccaagaagcaagtcttcacccccagccacaactgccagatttcattcattcatccatttgtttcttcagcaacaagcacttcctaagcacctgctagctgccaggtcctatgctgggcatggggtgagtgtggggttgatgaaccctgtattgatagcgaacggtattggggccccctcactaaccatccctacccctcccgccactctttcgggctctagggatgcggaacagggcagacgcggttctcagaagctgcccctcccccagcacaacgcgagggtgggctttggagcttatggcttgtcagcaaaagagagcgcatgcagggccttggccggtggcaacctgagggtagcaggttcccatcccagaattcccctgggcaggccagcttctgagggagtgtcctgttccctccggacttggctcgatggggagccccagccgagttactggcagtcaccaccctcccgggtcccacccacgcagcggccaacggaaagctctggccctcccaggctggagtttgtgccaggcaggctccagtagcggggcagggcccgggtgcttcgctcggcagcccccacgccccttcctccacacccgagggttggcagaggtcccctaagccctcggcctgttccgaccgcgcgcgagtctccgcaccactcggtgcccttgaccgcggacctcgctgcctctccattggcccggccggtcacgtgcgcggccgccggtcccagccggctacagagccgctgctgtgcccggtcttgcaaatcgccgccgtccagccgcctgctctggtgcgagtcttctccgctttacgactcggactcagaaaagccggcctgggcttcggccacttccccagcacccgtgtctgcccttccaattgcccctttcctgcctggcacgacctggccttgctcactgcacgcttcccttctaagtgagccttctttttcctttccctcagccagccttgaagtctccttcgacagagagtgagacctgctgtcctccctgcccttagtcgctgtcc

SEQ ID NO: 2540 - DNA, 1350 bp, artificial
  synthetic oligo
ctctcctcctgggctgtgaaagaaaacagggctccctctagctcctcctgaaaattggacaggcagctctccttctctctctctccttttgggatggcagctccacgagagaccagcctgggggatatgttaaaggcataagaaagggtaggtctctgtgggcacaagaacttgaggctttcccgaggtgggaggacaaggttaggctgtggctgggtgggactggctcacaccgagtggagggctacccctttcacatcccacctggaaatgctcctgcaaagatggagtgagagcctctcccttttctgcccaccttcctctcaatatggaggaacccacctccccgcaaaatgctgctctacagtcctttggcaattttccttttgaaaagctgaccaataaagtccacatatcatatacttccattcaaatgaaagtccagactaggaaaatctacacagacagaaagtaggttactggctgcttagggtcagggggagagagatgtaggaggaaaatagtttaaagggtatgaggtttctttggggagtgacaaaaatatctaaaattggctggtgatggttgcacagctccgttaatacactacaaaccattaaattgtacacctcaaatgggtgactctgtgctatgtgaattatatttcaataaagctgtttaaatgaaagaaagctgattgttggacagtccttccttagctgccccacctcgctttatttccaaggagccctggaagaacgtgtgccgtggatccttctgcacctggcctgtaccagggccactcttgggaatgttgttgctcgtgctgggcgccactctgtggggctgggcacctcgttgtgattgcagatggttggccaatgcaccgtgtgtgtgcagcaatgagaactatgtggaaggcatttaatacagtgactcacagggtcatgcttggaaaattaattcaaattggcttgcatcaagccaaggaaaactgtctgaagaggctgtaaacagaaggtaatggattgagctgaagcagggctagagggaaggcacagggggagacagctggcaggagggggttggtgtggggacctggttgggggtggggcacagaggctgaagtccgggaactccatctcctgccagttcctctccccactctggagtccccggtacctggcctgcttcccctggtcacactgatccttgtcactcctgggcatcccgggcatttagatatttctgtttgcactttctctctgtcccgactgggagctccctgagggcaggaaggcggtatctgtagacaaaggagagctatgagttccccgagtgtctgccccg

SEQ ID NO: 2541 - DNA, 1700 bp, artificial
  synthetic oligo
tcttccaggctcaagtgatcctcctgcctcagcctccaaggagccaggactataagcacgtaccaccgcacttagctaattattttattttttgtggagatggggttttgccatgttgcccaggctggccttgaactcctgggctcaagcaatcatctcaccttagcctcctaatgctgggattacaggcatgagccactgtgccctgccttgaagggtctttctgtggctttctctcaaggtaatgaagagtcatgaagggttttattttattttttgagatggagtttcactcttgttgcccatgctggagtgcaatggtgtgatctcagctcactgcaacctctgcctcctgggttcaagtgattctcttgcctcagcctcccaagtagctgagactacaagcgccggccaccacacctggctaatttttgtatttttagtagagacagggtttcaccatgttggccaggctggtctcgaactcctgacctcaggtgatccacccgcctcagcctcccaaagtgctgggattacaggcgtgagtcactgtgccgggccagaattttaaacaagacagaaaaatgtgtatttataaaaattcagccaggtgtgaaggctcatctctgtaatctcagcgctttgggaggccaaggtgggtggattgcttgaagccaggcgatttgaggccaaactgagcagcaaagggataccctgttactacaaaaaaattaaaaataataaaaatgtttaaaaagtaaaaagttccctccagatgataggagacggctgagcagggagacgagttaagggagagacagatagacgatctctgcttggtagtgagaggtggggaggagcagctggattcggacatgtttaggatttgctggtagcctggatacgggaagtgagggcgagggaagagccaggcgggacgctggggggatggtggtgccattctctaagcacggatatgggggccggggccgaggttggggaatttagtttgggacacactgaggtgaggtagtggcaggtcacgtaattgatgacttcagcaattgccctcaggccctttcacctttgctgcccttttctctggctgtctgcaggcagaagagtcctgaatggtcactgacaccggactgtacagaacgggaaacagatgccctctgtgcatctaaccctctccttgtttgtttgctcactgaaaacaaccaggcagtaaagcctgttacaaagactgagaggggaggatcactggaactcaggagctcgaggctgctgtgagctatgattgcaccactgcactcctgcctgagcaaaagagtgagatcctgtctcaaaagaataaaaataaaaagacagagaggcagagttccagttttctcacagatggcctggtatacttggacaaaacagttgcctcctctgggttgcagtttttccaaaatatgccaaaacatcccacgtgatcattagggggtgcaagtcagacagcagatacgcaagcaccaggcaaactgttaaggaacaaaatgcaaggtggcatcattaccattcacatcatgttctccgctttgaattgggccatttgctgtttctgtttacagttccttactcttatcattttatctgattgtacttttctctgataaccagtgaatcatgcagaccaggtaaaaacataaccaaaa

SEQ ID NO: 2542 - DNA, 1050 bp, artificial
  synthetic oligo
caggagaatagctggaacccgggaggtggaggttgcagtgagccaagatcatgccactgcactccagcctggtcgacagagcgagactccatctcaaaataataatagtaataataataataagaagaagaagaagaagaagaagatactggggtggagataggtgaagtcacttgccaaagtcacatagctggtaagtgacaggatgcggagccagctcctgcttttcctcgccacgcccgcctgacctacaggcagtgctcttcggacttcagtgctctctttgcaagtcaaagccctggccagcactgcatatcggtcacaggattctagtgcttagaaataaagaggagggtgttcccggaacccacctccctccaggtccccagctgggccctgtggcagccaaaggggagtgcccttgggcctccctctaggaaggaggtggatatgcagcgaatccactgcttgactgaattaagtcctctcttttcctcattccccctcccctcagccaggtcctcttccttgcttggctgaaacagcccacagagtgcttgcttccttctgagagggtgtgccctccacacctagcacccaagaacacaggctttcctttacttgctcaggtcttcattcagcagatgtttcctggtgtctcctgggccccaggccctgtgctagttgcaaggaagcccacgtgagacagtcaagtaatcacccagacagtggctgtggctgtgagaagcaccacaaaggaccagacggagaaaggaaaatgcggaccagaagtcggggagtctcccagggaaggtgttggggactgggctgaggtctggagggtgggtggtacttgtttaggcatgagagaggagggagagggcctgaggcagtggaaacagcgggtatgcgcccccgatgagggaaaggagagaaggcggagttggtattaagagtgaaaaagaggccaggcccggtggctcactcctgtaatcccagcactttgggaggccgaggtgggcagaccacgaggtcaagagatcaaggcca

SEQ ID NO: 2543 - DNA, 1300 bp, artificial
  synthetic oligo
ggcctcccaaagtgctgggattacaggcatgagccacggcgcctggccacctccttattatttttatttgttgatgtatttatttatttttgagatggagtcttgctctgtcacccaggctggagtgcagtgatgtgatctcggctcactgcgacctgtgcctcccaggttcaagtgattctcatgcctcagcctcctgagtacttgggattataggcgcacgccaccacacccaactaatttttgtatttttggtagagacagggttttaccatgttggccaggctggtctccaactcctgacctcaagtgatccacccacctctgccgcccaaagtgctgggattacaggcatgaaccaccgcgcccagcctgagatcctgtctctctcaaagaaaaatcctgtcatggcttcccattgcctgctggtgagaagcagtggatgacaacctctgccatgaacagccttggtctgtccaggctgtgccccacctctatgtccccagagcagctctcactgcacccctcccctgacatcccagccttcgggtcctcccaccagttcacagtaaacctgcccacagcctggggtaattggctcgtttattgcccatggaaaactcactaactctctgcatccatttcaaaattacctcttttgttcataaagccttccagaccctatgccacccacaatcagacataaagccttcctctcagcctttgctggctctgcctgcttgtccctctatttggcattggcatttattttatgcacactccattgcaggtgtgtctgccctccctccattgcaagtttcttgagggtggggagtctcccttgggaatctatggaagtcctcttgccttggggcctacttagaacatggtaaaggagtggtcaaggtcaatggaaaacgcattcgcttgttcaacaaattgtaatggaatgcctgttctgcgccacatagagggacacagtggaaaacagcagactgaggtccttggcctcatggtgctcactgtctcctgggaagccagtgtgaagctgctgtaccacagtgggcatgaattggatgtggaaaaactaagcaaggaaaagagaggcaggcaatgtggagctggggattttgattcgcaataggttgctcagggaaggtgacacatttgagcaaagatggaagggaggtgagggcaggatcctggcagatgtgtgggagagtgtcccaggtagagggcagagcaagcagcaaggtagcaaggtcctgaggtggctgttcctgagcgaggttgacaacag

SEQ ID NO: 2544 - DNA, 1100 bp, artificial
  synthetic oligo
tgcatgccctggtgacatctgttatggtgccatcttaccaggatgtcacaactggagatgtactgtagctcaggtccttactgtcttttgtctggatgaatataagagcttcccaaatgatttccctgttttcccctttccctagtctattcccagaactagtatagctactgacagttggtgctcaagaaatatttattgaataagtgattaaatgagtgaataaatagggacagatcaggggaaagttcagcagttgtagaccatgcagggcattataggccatcttaagaattttgaactttcctatgatcaatggaaagcatttatttaagaattttcatatggggggatgtgaggagtggtggatagtgatgtgatcagttatgtattgtagttaaattcctctggtagctgtgaggggaactgattagaagacatggggaggggcaaaagtggaagcaggctctcaggataagcctactgctacaaagaacaatcctcattctaagtgacttaaagcaataaaagatttacttctcagtgacgttacagtccaataggaaatttggcaggcagccttttacattgtgatttagggatcccagattcttccattttgttgtgccaccatcttcaacccatgtccttcatgccactgtagaatgggttttagggctagccccagaaatgtcattatatcactcttgcccacatcccatggtccccagctgaattgcaagagcagtttggagatgtggtcattctgtgtgcttagggagagaatgaaatggatttgtgaacacatagcattgtttctgccattcagggagatgggattgaggtgtttgtgggagtctagatgagagatgctgggggctcgtataagaatggcaacgttgaggatatagaaaagtagacggattcaagagatactaggcttattcatcccacataactgcaacttacccacccctcacccctggcttctggtagccaccattctattattctacgtatttaaaaaaaaatactccacctataagtgggatcatgcagtatttgcctttctgttcccggcttatttcacttaacataat

SEQ ID NO: 2545 - DNA, 1150 bp, artificial
  synthetic oligo
agcactgactggcagacatgtgaatgagaacatctggggccctcgaggcccactcaagctgtaggatgtcagcagctgtgggatgtcagcagctgtgtgagtgagcccagcaaagcccagcaggacagccagtcaacctgcaaaatcatgacacagaatatatcattattcttttaaggcattggggtgtgaagtggtttgttagcacaaataggtacctgaaacagtaagtgatcaaaaacagacaattggttaaagaaattattggatatctatacgttgaaatactaagatgccaccaaaaatgctgatgtagattctacacatattaacaaggaattatgttcatatatatttcaagtaacaaaatgttataaataaatatttataaataatcccattttagaagattttaatatataatgtatttatatttatatctaaatgtgtgattagcatgagccatattcaatcatttttgacttcccaaaacagctatttcctgtgatttaactagtacatattgatatactgaaaatgttaactgtggctctgtttggttggtgagtaataagcacttttgttgttgatgttcatctgcattctctaaatcttgtacatcaaatatgtatttcttcttgttttttttgagacggagtctcgctctgttgctcaggctggagtgcagtggtgcgatctcggctcactgcaacatccgccttccgggttcaagcgattctcctgcctcagcttcctgagtagctgggactataggcacgcgccaccacgcccagctaatttttttgtatttttagtagagacggggttccaccacgttggccaggatggtcttgatctcctgacctcgtgatccacctgcctcggcctcccaaagtgctgggattacagatgtgagctagtgcgcctggccaaatatgtatttcttcttgtagtattaagaaaaaaagaaggccaggtgaggtggcccatacctgtaatcccagcactgtgggaggccgaggcaggaggatcacttgaacccagaagttcaagaccagcctatgtcctcacagcaagacctgtctctacaatttttttttttttttgagatggagttttgctcttgttgcccaggctggagtgcaatggt

SEQ ID NO: 2546 - DNA, 5100 bp, artificial
  synthetic oligo
aaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgaccct

SEQ ID NO: 2547 - DNA, 1650 bp, artificial
  synthetic oligo
ggccttgccagagtctggactcaccagcactctgcagtgctaggctcccgaccacatctgacttcccctgtcccaagctctgcacacaggtggtggcaaaattggggaaattgggtggtaaattgggtggtaaaaaagttgggtggtaaaattggggattttaaaatgaggttcccaggcattgctactcctttcataactactgcaggatatttccagctatgtcagtgatccctctggtaatttatagatcggtatgttactgacaggaagggaagtcagcggccgattgaaaagcccagggtttgtgacccagtctcttaaagccttctgtagccttctaacatgaagcggcttgctagccatgcccacgagtgccatgatttccaaaaactcctcttttcctgcttcacagagttgctggacatcatcaccaccttgttggataaaggcatcaaaataagaaagcagattggctttttgtaatattgtatacagctgcaactcccccagggtcctgggtaaggcctcggccatgactgtgggtgggtttaactcagctagcagctgcggcggtcttggcgcgctctcgccgagggctgctcagccccaactcggaagcgacggccccggctctccctcctctggcagctgcggagtccgggacgcccccgctcacatcgaggagggaagggaaggtggtgggtgggctctccctgctgcctcccagctcgggcccgccgcttcttcccgccgcccgccccgactgcgctcgcttggccgccgtggcggcagcgcctctccccactcctatgtttttaattgagagccccgtaggtctctgtttcgtcggccctaaatgacctagggatggtaatgtcaaacaagtgaagtagtcatgtaaaccctcccacagatagcaataatagaacctggatgatacacccaaagacaattacttaaagacactgaaatgtctctaagagcagccagaatacagatgataatttactctaaaacttccagccgtaagactgtgattttgttgctttatagtaagaggatgacctgcaaaccccacagctatgactactgaaaataatgttagaaaatgatagccttaccagctcaaggtgccagagttcagaattcagggatgtaaaatcaacttgtaattttaattctagaaatatgattaaaaattttaaagggcaattccactgtgaaggtaactgcagcatgaatatgacccaaattctgaatataaattctatccaaatctctgaataacatcagaaaagcagtctgacaccaaagataaatctattcttgaaagatacgagataaaaacttaagctacagcagttttccagagatgggcaccaaagctctagagggcacttgtaattctttcatagattacagattttttaatccatgaaagattttgtgtggtggtggaggtgatgagaaagacctgagtgtcggaaagacttgagaatgaggttacaggttaaagagtggaggattctctccgtttctgccctcttacccttcaggtaggcccagattcgagtagtgatatctcaacatcaaagacaaataagtccttggttagaaaaatgaatagcagccattgtcctattactg

SEQ ID NO: 2548 - DNA, 1800 bp, artificial
  synthetic oligo
agctagtgaatgacagaattgggatttgaacacagtcttacccttccttaaccactaggatataccaccacaaaacaaaacaaaacaaaacagtgccttgcacatagtaggcactcagcaaatgaatgtaagagtaaatccatgcatgaaactatgaagtgcctgccttgtgtggggaatctggtctgctagtccaccaccacagccaccctccccaactacctctccctaggatactcttgttttctcacctgtccttccttcctccctcccttccttcctctccttcctttccttctttgctcccttcacttctccctccgtttcctctccttctctacctcccttccctcctttcctgggtgatgttggagagggagtgctgctttatgaagtgctatagccgggcagccagcccctgtccagccattctttcctttgggccacaaatgccctctgagcacctgtaatgcaggcactaaaggaaccaggaatatacatgaaaccagttctctgagtgcaataaaggagtgatctgaagggaggtttgggctgggagggacacacttcccaagaactctgatataaagcacactgagatgattgttgaagaaggcggacaactggggtccatggggacgatgagttaggacttggacattaaaaattactccatgcaagaagtggcattttagctgaactgttaagtatgaacaggagtttgaaaaatatcgatgggatgtgcattccaaatgatgggaaaatcgaggcacctgaaggctgttggaattgtgaatttggggcagtgcatccccaggagagatggtccccatggaggatatagactaggattgtgggcaatgcttgttggccaaagaaggtgttcccaaggtgtgccccaagttgcagatctgtgccacctgttcagtatttcccagcaccctccctacagagaagatgtttttccttaagcttccatatcacacctgatccaggtataggctactgggcatctcactgttcctcttggttatgttacgtcactggaacccaactgggtcctctaccctcttttcgtttactccttcctccctccctccctctctctttctccttccttccttctttccttccttccttctttccttccttccttctttccttccttcttccctccctccctccctctctccacatggtctcatttccagctcctgtttatattgatttcttacctccagccactcctaggtctaatttgggccctgctgccttgcctggttagtggctggtttctcaccccactgttatggcctaacttggcacactgtcaagcaggcaggcatgcagcagcaagcctctggtatgttcctactatgagccaggcttcgggccagggaaggcacccctctcctcaccccctgcagctggtgcttcaccatctgggaagtgaaggggcgggattctgtgatcttgaaagttccttccagctgcaaccttctaggggagtatctgaatgccctccttttgaagctctgagttctgtaggaaaatgattaccataaaaatgtttccaggttggtgcactggcttctgtcagggcctcactgtttgacaactgctgtgcagacttaagtgatatttacacacaaaaatgttttaccgtgggatgccatcattaccctagtgtcaggggccaaggataacagcccattacaggccttccctgttatatgaagaaagaaagattcattcattcattcagctaagcccaactgtgtacacaagtctgtactaggt

SEQ ID NO: 2549 - DNA, 1100 bp, artificial
  synthetic oligo
tcaagtagtggcgaaataatgcgcactgcttttttgtgttgtcgtcggcggaatacgctcagttgcctagcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccggtaagtcatgtgagcgcccgcccccgcgccggcaacagccctgcgtcgctgcggcgcgccgcgccgcgccgcgcctgcgtactgtggcccgccgcccggcgcgaacgggcacttccggcgcgaacgggcacttccggcgcgaaccgctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctgg

SEQ ID NO: 2550 - DNA, 1000 bp, artificial
  synthetic oligo
aagaagtccattgaaggactgagtttgggacactccgacatttagagttggagaagaagaggaggcctcttcaaagaacactgagaagtggccagtgaggaggaggagaacgaagggagtagactctattatttcaagaaagatggcgtggataaactgttagatgctgctcagaaacacaatagaacatggacagagaagtgacttgggataaatcgtgttcctgtctatctcttactctgggaccaccactgagctcgagactgccagacacttctttctaaactcagcacccagcaaaggacctggcacatagtaggtgtcttggggatgtgtgtgagatagatgagtgaatgaatgggccatgaactgaaacttctaatcttggctatatgatgaacttgttccttctctctctgacttgacttctctaggaaggaattttcctcaaaattctttcaataaactccttgactaggctggtttttctttaaagtcctgggctggctgctcaacttgtggataaggagaaaagaggcctacaactccaccttgactgtgtttggactttttaccaaataatcatgccttactctaggttgttaaaccaccctccttgagaatcccactgctcatctaagatctgttgcccatctctgttctctttggtaggtacatggtctgtcatcttccttgccaagccttttcttgtcctcgcacttgtttggtatctcctgtctgtccttgcagcagctattgcaaacgttctggcctccaaagtctgcacctactgctgcctggtgtctctgaagatgagatccccccatccctcccatttcacttagaacactggggttttgcaagagtgaatcccttcaactgtcttgtggcctgtttctcagcaaccccttcccattgtcctggatttgtctcctgtcacttcctctggtacctgaaccttcccattccacccatgtttcatgggcttcagcctcaactg

SEQ ID NO: 2551 - DNA, 1050 bp, artificial
  synthetic oligo
tatatagtctctccaccactgttcttggcccctcctcaaagtctgtcccctgcacagctgccaaggggatctctacaaagattgtaactcctgcttagaacttttcagtaattttccatctcatgatgaataaaatgcaaactcttcccctggccctggcctccaattcctgtgtaccttctgatctgatgttctgcctctttccctgtcctccactatgttctggctataccaactcccttgctattcctcaaacacatacgcacctactgcaaggtatttgcacatattgatctgtttggcttaaccccaattaatccttcccatttatgtctcatttcacacaccacctctgcaagaaagaatttcctgacctcccagaccaggtcaggttctccattgcatgctttcattgcatcaaagctcttagctcagatgccaatattcctttattggtgtgcttctctgattaatatcgttgtctttcactaaagccaaaagctccatgagggcagggattttatctgccttgttcaaaaccgtccttccggtagctagaagaatatttggtacatagcagatgctcaataaatagttgttaaatggctggatcatggaaataacattcaaattgggcttaggatataagcagatatttaaaacaaaaattataggcacttggcgcctgagtggtataaacggagaaaaacagatttcaggagtaaaaactacatgagcaaaggcacaaaggcatatacatagagggcaggtggagacactgctgaggattctggcatagcaggaaagaaggtttctgtggtgagaggtgaggctggggtgacagtgtgggggtctgtagcctggagcctcatctttgtctggagggcaacggaaagcttgaaacggttctactttggggaacactggccagaagtgaagactgccttttaaaaatttatttatttacttttttaatgcgacaaggtctcactctgtctcccaggcttgagtgcggtggtgtgatcgtagctcactgcagcctccaactct

SEQ ID NO: 2552 - DNA, 1200 bp, artificial
  synthetic oligo
atccaggggagagcaattgccagggtgtatgagagagaccacatgtgaaaccaagtccacagagccccaggcaggctggtactcagtgctctgaatccagagttcagcccagtggggtcaggaacctgaggaagaaaagtgggaagggaagagggagaacaggacaaccaacaggattagatttgggaaatcgggcaccatcatcaccaattggactgggccctgtgatctgaatgtgcaggccttttggctgaatgcatcagccgcgtgcaggacaccacaccctccctcagaatttccttccctctgtcaggaagcatatggctggcttcctgcatctttctgggcaagctgcctctcttgacgattccagtggtcctgtgcaaagtctgcagcattccagggctgggagctgtcttcatgcctgctgggggctggtgttttatcccctggggacccttcaccaaagctgggctatgtgaatgggttggtgactgatgaccgaaagccaagatgggccaggaatgcagttgaaggtggcagtgtggctgcatggagggaaagtcggaggaagagtgccgcgggactagtctgctcagactctgcacatgaagcactgtgtggggaagtgcagtgaaagcgatccaggtggtgaacatgtctcagatggcttcctgtgtcttctgagctcttggaccacaaggggcaggtgtcctgaagctgtgaccgcttgcctattttgcctccagacactgtctagggtagagggctggcccaaggtgtggacatgggcaggttggatggaaactcagtagagatggcacaatcccttgttaaactgacagggatgtacagggtccaatgcatgaagcatcatgcaccatcctgttgggagcatcctcatctccatgatggtgtttgggcctgggaaggaggcatccacagtgaccctctcagtggtagtttccatggaaattttgaactcaagcaatcataggtgagggaagtgtatgtttcctcatggaggcaggaggcctaggtggggtcaggctctgaaatttaaatcagtgatttcattgatgccttgcctggtaatttcattcattcattcatttgttcatccagcaaacatttattgaacacatgctgaggacacaccaagtcaacaatacaaaagaaagtggcaagccccttaattca

SEQ ID NO: 2553 - DNA, 1200 bp, artificial
  synthetic oligo
ctgtgagggaggatccagggaggatccaggagagagccattgctagtgtcaatgacagagagcacatgcaaaaccaagtccactgagacccaggcaggctggcactccgagctctaaatccagacttcaggccggtggggtcaggagcctgagggagagaagggggaagggagggggcaggacaggacaatgaacaggaataggcttgggaaatcctggcaccatcatcaccagctggaggaggccctgtgatctgagtgggtaagcctgttggctgaatgcaccagggctgtgctggtcaaccttcccgccctcagaatccccttccctctctccggaatagtttggctggctccctgcatcattctgggccagctacctctcttgaaccctccagtggtcctttgcaccttcgccagcatcccagatctgggagaggccttcatgcatgctgggggctggtgttttatcccctgggggccctccatagaggctgggctatgtgagtgtgttgctgactgatgaccaactgccaaaacaggccaggaatgcccatgagcagttgaaaggggcagtggggctgcatggaggagaaatgggaggaagagtgccctgggactagtcagctcagactctgcagatgaaggattggctgtggacgtgccttgaaaatgaaccaggtggtgactgcgtctcagatggacttctgtggcttctgaactcttggcacacaagaggactggtgtcgtagggcagtgatcgctggactatgttgccagcagacactgtctggcgtacagggctggcccaaggtgtgtacatgagcaggttgtatggcaaggcgttggagttggcagccttccttgttaaactgatggggatgtgtggggtccaataaaggaaacatcatgcaccatcctgttgggagcatcctcacctccatgacggtgtttgggcctggggataaggcatctgtagtgaccctctcgttggtagtttccacgggtttttctgagctcaagtgagcacaggtgaaggaactgtgggtttcttcatgcaggtcggaggcccaggccagaccgactccataatttgaaccaaagaattcccatgcctggtactttcattcatttcatgcacttattgattcctacagaaaacttttattcaatatatgctgaggaaacaccaagtcaaaaa

SEQ ID NO: 2554 - DNA, 2050 bp, artificial
  synthetic oligo
agaaacccacagttccatcacctgtgctcacttgagtttagaaatcccctggaaactatcattgagagcatcactgcagatgcctactccccatgcccaaacactatcatggaggtgaggatgctcccaacagtattgtgcatgatgcctcctgtattggaccccacacgtccccatcagtttaacaaggaagggtgccatctgcactgccttgccatccaacctgctcacatacacaccttggaccagccctctaccccagacactgtctggtggcatcataggccagtgattagagccccaggatacctgtctgcttttgtctcaagagctcagaagcctcagaagtccatctgagacatggtcaccacctggatcattctcattgcacatccacagccaatccttcatctgcagagtcgcagctgactagtcctagggtactcttcctccaaattcccctccatgcagccttgctgccaccctcaccttccactgctcataaatatttctggcctgtcttggctgttgctcaaaagtcagcaacccattcacatagtccaggctccatggagagttcacaggggataaaacagcagcccccagcaggcatgagacaactccctgccccgggacgctggaaatggtacacacgaccactggagtggtcaagagagggagcttgcccggaatgatgcagggagccagccatactcttcgtgagagagggaaggggattctgagggagggttgcgtctccagcacatcgctggtgcattccatcaacaggcctgcccattcagatcacacggccccctccagctagtgatgatggtgctggaatttcccaagcctattccttttcattgtcctgccctcacccctctcttcgcccttctctccctcaggtccctgcctccaccgagctgaactctggattcagacctctgaatgccagcctgcctggggaaatgtggacttggtttcatatacggtctctctcatggactctggccattgctctccccttgtatttgttcattttcatactgctatgaagaaatacctgagactgggtaatttataataataaaaaaaagaggtttaatggactgacagttctacatggctgggaaggcctcacaatcatggcagaaggggaaggaggagcaaagatatgtctcacatggcagcaggcaagagagcatgtgcaggggaactgccctttgtgaaaacatcagatctcctaagacttatttactacggcgagaacagcatgggaaaaacttatccctgtgattcaattacctcccacctgatccctcccatgacacgtggaggttatgggagctacaattcaagatgagatttgggtggggaaacaatcaaaccatatcagtgctggatcctcccgattaccctcatgggctgagggtgtcctgtctgctctccttccctggctcctgttcattctgaccaattccttctcaaagcacaagagaaatgtcctgtccccatttcagaatgttaaaccatgcctagagaaatgttactcaggatgtcactgtataaatccaacttcatatgggtgagggattaagttagtgtgtacttaacctaattagagaaagcaaagacacaaaataacagtgaaacaatatttcttcactaaattttattcataattttcaccaaaaatgagaagattgataacacaaaatctttctgtgagtgtaggatattcacatctattaatttgtgagaaaattaattggtacagtatttttggaataaaattttgacaatacttctaaaaagttaaactattcacaccatttccactttaacccaatgtccatgttactatatctttcttattggaaagcatgcatatctgtccaaaaacgtatgtttatttcagttctattaatcatagcaacaaatgggaatgaacgtatgtgtttatcaggaaaggaaaggtttaattaactatggcacacacctactttagaattctagggaatacttacaaaagtgatgtcgattgtag

SEQ ID NO: 2555 - DNA, 1300 bp, artificial
  synthetic oligo
gttctatatctagacttgtgtagtgaatatatgagtgctgatttcataatcactgctaaactgtatgtatttgcaggttttttgtatatttcacacttagaaaaatatttaaatgaatatatttaactaaggattagtacacaaaaaatatgtaagaaactcatataactaacaagaagatgacaaataacctgctagaaaaaaaatgggaaaaataaataaacaggagtttaacagaaaaagaagcacaaatgtatcatagacatttttattttatttatcttttgtatagggatggggtctcgctgtgttgcccagatggggcctcaaattcctggcctcaagcagtcctcctgtctcagcctcccaaagtgctgggactacaggcataaactaccacacccagccagtaagtaataggcacttttaaacagctatattgagatataatttacatctcatatacgccatccatttaaactgtatgactcaatggttttagtcatgcatttaattaccttttctttttagttgtccatcactgctcattcttactctcttcctctctctctctctctctctctctcacacacacacacacacacacacacacacacaccccagaatgtagaatccttgagggcagggactttatcttcttcacttgctgtgtcctaatatctagaatggtgcctcagaattgtaggtccttaataaatgtttgttagttgactggaatgaaggcagtggagatggagaaaactgaatcgacgtgaggaataggtaggacccggcaatggataggatgtggggactgatggagagggatgtgtcatgatgacttccagatttccggtttgggccattcagcagttgttgatgtcaataacagagccatagaacactggaggcagaacagattgggagatacaaatgactggaagtagaatgacatcttgtagtgaaaagaacatgtatatagaaagtagaaaaactgagtcatagtcctgaatttcctgtgtaactctgatcaggcaactgcccacttctggacctgtttttcttttgtgagttgattggtttggactgaaaaaacattctgggtttttgcatccagatcttggtaaataatttaggacatgtagaatctgtccacagaggtatgtttcactgagtccatacccctcaattggcttatagctattatcacaaatctgtctgtggcatcaaacctttgcccagagatctctgaaatttctagagagtgatgcacctgggctgacaaacaagtcgctcatct

SEQ ID NO: 2556 - DNA, 1750 bp, artificial
  synthetic oligo
atgggagcggattagaggaaaaaccaaagatgaatgctgagcaagatgataggagcagggttgtgggaaggagagtgcctcctcagccagccagtgccttcccaggtggtcaagcactttctccttggatcctcaacaagcctgttgagtccagcaaggtctcccaatatccccattccccattttgtatagggaagcccaaagtttcagacagggaaaggggcattctgaagatgcacagcaagttagggacagcatccttttcctcaatggccttctactctcttggaataatgttgagtggcctgaactccttgcctctgtactggctgggaacactggatgtactcctttcctatgactgctgtatcagattaccaccagttgagtggcttaaaacaatgcaaatgtattatcttatagttgtgggggccagaaccccaaaatcagcttcactgggctaaagtccaggagttggaagctctgaggcttctggaggctccgagggaggagttccattttctttcctcttttgagcttctggtggccgcttgttttccttagcttgtggccccttcttccatctttgaagcacattactccaatctctgcttctatggtcacatttcctgctcttcttctgtagtaaaatctccctctgactttctcttatgaggacacttgtgattacacttagggcccacccagataacccaggataatctccacatttaaagatctttaacttaattgcatttgcaaagtcccttttgccatataaggtaagaagagtaacaggtctcaggggttagaatgtggacatgaagctggctaagagaggcaagcccttgggtaaagcgtcacctcacaaaagaccctgcttggcttcagtaggctgaggaccttgaggaaactctgctagatcactacagccctgtctgccagaactatccagatcgttcactgggctggtttggcaccagctagtgattgtgaaaactgaacagaagtcaccaataggatggtgccaacttagtgctagaaaatgtgggaggatcggcagggcaggttcacaaaggcccgagaatccagcggcccaggtgagcaagtgcctgtcccagcactgcctccaggctcgggactggggcttccaatcctgggtctggacttcaggtcctgcaggggagggactcagacttacacatcctctttgtaccttgtttgctgctgggattagaatttaggggagtgaagttcagggacgaatctaaggcctcccagccaaaggccatctagccacagcccaaacaaaggggcttccaacatggtcctaggtggcactgagaccaagcctgcagagactgggccctgtgagagaggcaaggcaaggccccagggcactgcaggctgttcaggtgagggcacctcatgccactgtggaaccaggagctcccaaggtccctgttctgtcagcatgagtgtctgattgctcccttcttcaaagccggctctggctcggaacgctgggtgctgagacactgcctttggtgagcatgggctgcttaggagctttagagggactcctgctgaactggggggcctctctctgcaatgccttctgccctgtctgcctgcctgactcccacatgtatctctatgggctagtagcctggtcgagtgaggctccctctgtgcctgtccagtttggcaccagctaatgattgtgtccaggggctctggacctgcctct

SEQ ID NO: 2557 - DNA, 1200 bp, artificial
  synthetic oligo
tgccactgtaaatccagcctgggcgacagagtgaaactctgtctcaaaaaataaaaataaaaaataaaaacaagaaatcactctatatgtgctcttaggtgtttagctttcttccctcgacattatgtttgtgagctgcatccatttgtttctacactcattgtcattgctgtagagcattacattgtgtgaagacaccataaattacttgttccttctaccttaatgggcattagggttgcttttggctataacaaatagtcctgctctgagtatttcttgggtacatgtttttaaaaacatccgtaggctgttgagtgggaacctgaaagtgggattactaagtcagaaagtatgtgtgtatttggcttcagtgggtaagctgagtttcccaagtggttgtaccaatgtaccctccccaccagtaaaatatgagtattctagttgccaacaatcagtattttctgtcttcttaattttattttattatgttatgtatgtatgtatttatttatttctttttagagacagggtctcactctgttgctcatgctgcagtgcagtggtgcgatctcgggtcactgcagcctccaactcttgggctcaagcgattctcccaccttagcctcctgaatagctgggacaacaggcgtgcttcaccatgcctggctacttttttattttctagttttttgtagagaggagggtctcgctgtgtttcccaggctgttctcaaactcctgcactcaagcaatcctcccacctcggcctcccaaaatgctgggatcacaggtgagtgccactgtgcccggcctggagttgtttatttgtttgatgtattctggatgagggttttgttgaagatgtgtatggtgaagatctcccacatgttgagtatcctttcactttcttaacagtgtgttttgatgaacagaagtttctcactttaatatggttcaatttatcacatttttggtcacactcagcacttttcgtgtcacacttaagaaatctttggctgttgccagttcacaaagacactctcctatgtttttcttctaaaagctttattgttttacctttcacatttaggtctgcagtttgtgtggaactgatttttttatatgatgtgtagtaaggattcatagacatttttttttcccatatgggaacccaattaacccagcactttttgttgaa

SEQ ID NO: 2558 - DNA, 3100 bp, artificial
  synthetic oligo
cctgaaagaaagacagccgtggggcgtttcctgctggggacaggtggagtgaagtccttgctctccttgcaagcagccgaacattcaaagcgaggctgacaagttcaagtcatcctctgatccttctagaaatatcctgctaaaagccaatcacatgttttctttcaaatgtgtcattttgcacagatgtttaaactctggcataagcagcaggttgcatcagcctctcttacatctaaggcctgcaggatcccaataatttaatgttgaccaaaggaagaaagcctccttacaaagtggcagaaagaagaggatcaagacctcaaggagggttttctcaggacacctactgacagaagcactgtgcatcatacctagcatgtagtaagccctcaacaaatattagctttattattagcattgttagcacagctcccacgaacagtccccgatgccgcatgtaagtggctaactgagcaatttgaacccagtggggtaataatcttggaagttaagagtccgggctctagagtaagacagcctaggtccaaatcccagctccaccactcactagcccttccgtgccatagagtcctcatctgtaaaatggggataataatagtatttacgtcatagggctgtagcaaggatggaatgagatgttttcagtagagcgcttgggacagcacctgacataaaaagcattaagtcaacatggaccctcaaatcacccccttcagctgagctttgtcaaatcggccttgcccatctattaacagaatcttgagcaagtttccgaagttactggtgtcttgcagttgttaaaactcagaccagattaaaatgtcaatctcagactcagtttcactcttccctgagcccctggctgctctgagaccctcctgccgccctaccctgtttgggaaaatcaaaggacactggctgtctcatgggaagggggaggagtgggggaaatacatgagcccttttgaaggctctttgagacttgagtaggtttctgctccttgcctcagaggcatcttaacaaaggtgactcctgacaccttcctgtaggctctttttgcgtgggggatctctttgaggggagctggttggagctccttcctggccttctctgatcatccaacacacactcaaccattcccatactgcctaggtgatgtcatgccctcccgtggcctcaaggggccatcgctagctgcctctgcccctacaagcttggcctctaccctggacggttcctctgagctcctcccctgtggtgtcctggtgtcagctcatcttatccactcggttgccatacaggccccacagcctcactgtctcccaagtgaaaatcagatctctatcctattcccttcccccaactgttacccgtggagtctctaattcctgaataaaagatctgtgcaagtaactgaggccagcaggcccctctgtctctccttcccagcccagactctctttgggcaaagctcattcctggctattatgcacaccaaacaccagtccttcaatttggggctggggcaaacagtttaactctccagtcttaggaggagaggtctcccttgtcgaagatgggagtggaggccagagaacggggagatgaaagtatatcccagccacgtaggaacatttctgctggtgcaagaaacctacatcaaagtggccacaagatgagctaatagaaggtggataaatatgagtccatgtttactgcactttatgtggaatcttgaccatgtagggagggaagggcctgcctgcgccattctcctgctcccacccctttttcccaagctgagcaggagcccccttgggtcttggggttgactttatagcatttgagattcttatctcttccttctagtcttttgaagtacatgatgacactctctccttcctctgccttttcctctggggaaatataagaaaggaataaagacttatttgtctggaaaaaaaccaagtccaacttttacaagtagagaataaactacaaacaacttcaatctgatggttgactttcactgacaagaaatttcctcctttcctctccatccccatctctccttccttccctctttttctaaacatctagcagcctccttaactgccctgtaggcatagccctggctaatacctgtgactggaggagctctcatccacccaaggtagacatcatttcaccatgccaggatgcaagctgtaggcgaggcctgaggctcaacagatcttggaatccccctctaaatgggtatggtctctgcagaattcaggctccccttctagtctattcttctgaggaccatctctttctatttttccgtcaacaccctctgcccctcctctgactccctctcccatcaccgctactcctccatcctctggctaccagtttttgcctcagtactaggtggctttttaccagactgaacccctcagggtccaggcctggctcaaagcaggtgctcaggacacaagtatgggccactggaagccctgtatcgtggggagggagcagggagtagggcttcaggaagtgtctgcaggagtgacttcatacaatccactacgattctgatattttaaaacaaataatatgtgtgactttttaaaatgtcatgtaaaaacacgatttaacttgtctttaaaatataccaggtatttaccaggttcgtacttgtgaacaaatattgtcttcatccaaacgttaagaatggctaaatgccatcatgttccctcctccaaagctaccctcttggaaaagacaaacttgtccaaagaggctgccttagtctagaacccaaaggacttgtcacctccataatttggagacacagcatgagcaagcttcgcctgccaccccacagccccgccccgagcctggcatactgggccattgcagattgggtggcaatactggcagacatctagttctaaaccttgagtttagaaacatgggcacttgcaaatggcatctctggtttctttctgtcctggaaacgatcatcgtctgttccctccaatgctcactgagcatttggtgcgtgccagcccccatacctgttaccta

SEQ ID NO: 2559 - DNA, 1000 bp, artificial
  synthetic oligo
ttagatcaccacccagaaggttgccctgacttatcctcccactctcagagcccctggggcagaagagtgcccattttcccacacgccaggtaccccagggttttgcagatttgttttaagttttacatacctgaggcaggggtggaaacagttgactttctttgcatttccttcatatgctaattggtgacccgcaaatcttcttttgtgattatctgttcacttccttggtcctttgctgattttcctactgggttgctttaaaaggagtccttttttattttcggaagattaagcctttcgctgtcatatgcagttcaaataactcttcctcatttgtcatttgtctaatgacagttatggtgggttttgccatacagaagtttttaatttctccatcttttatggtttctggttttcatgacatacttagaaaggctgtccccaccccaggattctttctcatacttttatggtttcattttttttacattaaatttctgagccatctggagtttattttggtgtggagagtgaggtaggaaatctagcttctttttccaaatggccagttattccaacatcatctcttgaatgatacacttttaatccacagattcaaaatgccaccttgatcacacactgcatttgaaactacactctatccctccgttcatcaatttggcagctgcttcctgtgtgcctactcaggcatcatactagcatgaggtgtgtttcctacatccaggaggaagggagaggagacacaggagacagcgaccctgcagggtaataagtgctagggtggaaggcggtggaagagacacttagctgggtcttggtggttagggatgacttcttgtgaaggcaatgacctctgaacagacatgagcatagtagcagttaaccagtgcgagggaccgcagtcagcactaagttctagagacagaatggaggcctatgttgggaatcagcaggaagtccagtatggcttccatat

SEQ ID NO: 2560 - DNA, 1900 bp, artificial
  synthetic oligo
ggcagcagcagggcccctggggggcggggttgggcccagctctgggggaggagctcccagctgaggccaggcagcctccagagtctccaggctgaggaccgcgggggccctcggcacggcccctagccggcagtggctgagctgagcttggggggatgagggggcgctgggcagggagcccactgtctccttctcatggcttcccttcctccttatcccaggagcctccctgccggccaactgtactaaaactccggaaaaccatggcggggaggttttccaattagaacattctttttccgacctgtggatgattcttaaagcagcaaaaagccattcttcagggcatgcagggagtatctgccagcgaggccttggctccactcgcgcactcgtgctcaggaggcctggcctggggctgcttcagagccacagacaaaaggcagagcctgtgttgtggggcatcaggtcacacagaccaagactgatggctgagagtttcctgggctcattcgaaccagtagattcaaacggcagtggggatccaggctacaggagtggcagatgtcagaccacctctctccttgctttgtgacaaggccactgctcccaatgagaccactgttcacacagcaaacaatccccaggcatggctgctgtcccttggagtagaactgggctgcctcctcccccaaactgggagccgcaacaggccgggacagggtctgactggtctctggccagggttggggtggcagtgcagtggggcaagtaagaatgtgtgtgtgttccagagagggggaccacaaccccgtagcttggagtgcaggctgagaacagggggagaggagcagccactccacatgctgagaggctggaccagctcctagcaggagagctggttacaaacacaagggcctggcctcacgggttcggggctcaaaggacccatcctacctgcaatcacacctggggacccctgcctccagggcatccaccctgcttggagtcagcagagtcacccagcaagtgtaaaccggttgaagagcttaagaggatgaggtggcagggcgggccccgggaaggaggggattagggatcaagcaggagcccagccctccccgcacatgaacctgagcaccccagcttctctccagctgggcaggggctccatccagagcagctggaaccccaggttctaagcccagctctgcctcagactagctgtgtaatcctggcaacatcttgtccctctgtgggcctctgttttcccatttgtacaactgaagtgttgaggttgcctgcctgtcttcagtcccctctagctgaggacactgcctgggggagctttgcggcctgacagctttcagggcccaacccctctttctccccctctagcctggtaactctttttgttttctgtattttttgtagagacggggtctcaccatatcgctcaggctggtcttgaactcctgagctcaagcggtcttctctccttggcctcccaaaatgctgggattacaggcgtgagccactgtgcccacctcctagcctgggaactctggggctagatcaccttgcttgagttctcttcccagccctggagatcagaatggggcctcccctggagctgaggagtgctgctggccagttctttcccagcagccacctgccgtgctacccatctcattgcttagatgcagcctcccagagacgctgcctccacggcctgcttgtgagctatggcttctccagcacagggctcaccacctgctactccctgcctctacctttcagcctcttgcctgcccagacagcccagcctggccccaccctgaagcccctacctctcacttagagccttgctgagggcctgcttgttggtgggaagagactg

SEQ ID NO: 2561 - DNA, 5500 bp, artificial
  synthetic oligo
cagggccttgcacacaataaagcactcggtgagcaccaacgcgtgacacaggtacatcaaaccgcattggctctgggagtctggctgtatctcgtcgcccagcctgggagatagccccgtttgctgtgccttgtgagccccgggtccgtcccaggatggccttccacgatgagcggctccctcactcttctcctcctttcctgcctgcaggacttcctggatgatctcagccgccagccccccgcccccctccccgcccctgtctgggatctccatctgtaaaatggatctaggaacggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggaga

SEQ ID NO: 2562 - DNA, 1900 bp, artificial
  synthetic oligo
aaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcatt

SEQ ID NO: 2563 - DNA, 1950 bp, artificial
  synthetic oligo
attaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagccc

SEQ ID NO: 2564 - DNA, 1250 bp, artificial
  synthetic oligo
ctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggccc

SEQ ID NO: 2565 - DNA, 1300 bp, artificial
  synthetic oligo
aaagtctccttgctctgggctggtggggaagcaactggtttctcccggtacctccttccagactccctggctagatcccttccgggtttcacaacccaactgtccagcctgtgtgctcacatgcccactgacacagtcacacacacattcactcacacactcatgttccagacacactcacatgcgcacacacattgagtgacaaacacacattgaatgacgcattcatgcctgctcattgacacacccacatttgcagtcagcgcacgcacgcacaatgactcacaaactcacacacacactgacacacactgacacactcacagtgtcacacacattcagcgacatgcatgctcaccttcaatggcacagcctcattcccccacaccctcccactcacacacgctcagtgatgcagtcacattctgtcacttggattcacacacattctcagaaactcatgcacatgctcacactgacacacacacgcacacgctcaaacacacccgctcactcacactcacacctgcttgggaatcacggcacacacaggtccactctgaacagggaaaaccaaggagccctgacaggccctggcaaggtcagccaagctctatgccctctcctcttgccctgtccccaaaatctggaggggcccttggaaagtgagcagttgacttggccctgctgagacacaagggacggacatgctggggttgtgcccagcctgaagaaggcagggagaacagagcacagtgggggccccaggcatgcctgcagggcaccccgatgggacacactacaagggtccctgagacaccggttaagcaccttcaggccggggaggctgcaggcccagccccagagacctgccgccccctgcccctccccgacagccccgcaaaactacccctcccatgcctgcactggcctgtgtatgccgagtgtctcccagggcccctgccgccctgcagacctgctgactgcagctccgctcaagcagacaggtcgcctagatccaggattcctcagcccaggtgggcagccacccattcccagcattggctctgaggctgctttgggggagcctggctatcatctgagccatggggatggccggaggctctgtgctccagaacagccggaggaagtgtgtggacacagactgagtgagccccgggagaccctcgccacgtccaagtcaatgatcccgtcccctccccacacatgtgcagggaggggcctatcacttgtcccagttctgtcgcccacagactctgggctagttaaatggctgatc

SEQ ID NO: 2566 - DNA, 1150 bp, artificial
  synthetic oligo
tcctttctcagcttcttcctctcccccaccccacttttgggctgacctcctccctctctacctgcctctctgcccttggaccttcctcctcctcctcctactttgctggatctaagcgtggtgggggcgggctcccagcctcaaccctgggacatacggcacctccgatgaatgctctgtctctggacgtgacctctcttccaagctccgcacgtacccatccatctgcccacgtggatgccccgcagacatttcagagctaagatgttcaaaccggagggcttcgtccccttcaccatgcctacactgtccccgggcttccccctctgtgcaaagggctctgcctcctacctggtgactcaaacaaagcagccaagattctctcccctctcctttgttcctcactcccaaatctaacccatcattggattttgttgactctgctccaagactgctacccttctcatctccgtggtccttggcccgccctgcctcctgttctccctgcctccactccgcttcctccctgctccaccaacaccccctcagcagccagggtgatctttttgcaacaccaccagaccctgctcctccctgtggcaccccatctccttagagtaatctcaaagtccccatcctggtcaagagcaccccccacgctgctcctggggatctggcttcctctgatgctctccttccttccccgaaatccaccccatgttgccatgcccccagctcctctcaccacattcctgccgatctggcctgttcagctggccccaaagcacagggcttgttcccaccttcggcctttgccatccctccttcctctgtgtgagccatccaggcccaagaaccttctgtggcagcagcttcctcctgctcttcctctccctcctcctcctcctcctcctattcctcctcctccccctcctcctcctccccctcctcctgcacctcctcctccttcatgtctcagctgaactgtcccctcctcccataggccccctctgctgggacacacaaatcacgtgccctcggtttatattcttattggcggcatcagtacatgtgtcggcacgtgagaaatgctggtctgagtctttgcttttgggtatcaggggctccctccccaggtggcaagctagag

SEQ ID NO: 2567 - DNA, 1700 bp, artificial
  synthetic oligo
acacacacacacacacacacacgcacgcacgcacgcacacacacgcacgcatgcacatgcacgtacaacctgccctgcccctagcctgtcctccgcagcctcacaggtgcaggtggctccttcccacctagcagggtttttctgagggacaacccgatgtggcacgccatgcttcccagactcagggtcctgctgggctgaataagtgtgagcttgttctgcgttggtccttgacacagctggttgcctgtggcacagtcttcaactcattgaagtcaagtccctctggaggagtgtggtttggggagaagaaggcgttggttgctttggggatgtcaggctgccacggcgtgttgtactgggccgtgtcccctcaggggctgcactgtccaatagaaacattatgcaagatatttatgtgttttcaaaatcttctagtagcctcatttagaagaattttgccttatttaaaagtaactggtgaaattaattttaatgatgtgttttatttaactcgacatatccaaaagtgttatcatttcaatgactgatcagtataaacagttaccgatttgatagtttaccttcttcttttgcaataactcatcactcacggtttcttcctcctcttccagcactgccttcccagtgttccaccattccccaaaaggattccaccattcctcagaagagggaaggctgatgggctgacagtctgttcaggggtgagctggggtttggttttcctcctttaggactcctttaactcttggggatgcactgtccccctctgccccggagtgtctgctgacctattatagtttctccccaggagcttaagcctcaagtccctcacttccatcaattgcccatctcagaggaaggtgggcacaatagaacatctggctaaaattttctcctttccacctgccatttgatcattcatcacacctttgagagctgctctgtgcttcaacattttctattatgcgaagtgtgatacccagcccggggccatcggggaacttagggtgttttcaggcagggggtgtgggacaagccatgaacataaaatgatgaaatgacaagaaactgcaaaattaactgcccatatcagaagtttaaacacgaagtgatatcagggacaaaagaaggagaaatgcatgctgcatttggagacttggaagtgagaggcagcggcattccaggctagaggagagcaaaggcttagggacagaaatgagcacagccttttcagggactagtgagaagacaggccaagggtgtgttggggcaaaggtccaggtttcatgcacagagtgaacctaggtgctgtctataccctttgaaaaaaagtttgtattttggtaaaatacacatagcataaaatgtaccatcttaactctttttaagtgtacagtccaataacatcagcacattcagtgttgtgcagccatcaccaccatccagccatagaacttgctcatctccccaaatagaaacactgtccccattcaacaccaactccccaacctctcccccatcccctggcacccacaagtctactctctgtctctatggatttgaccactctagggacctcctgtgagtggaatcctacactatttgtccttttgtgtctggcttctttcactgagtacaatgtcctcaaagttgatatccacacccttggctaccgg

SEQ ID NO: 2568 - DNA, 1350 bp, artificial
  synthetic oligo
gttgacctgtaaccgcgccaggcacctgggttaggtgcaatggccctgcgcgcccatgacttgtaacctcgcagggcacctggagtaggggcaatggccttgcacgcagatgacgtgtttccccgcagggtccctggagtagaagcaatggcgctgcgggcccgtgacctgtccctgtgaagggcgcctggagtagggacaaaggccgtgcgcgctgctgacctgtctccacgcagggcacctggagcaggggcaatggccttggacacagatgacctgtttccctgcagggtccctggagtagaagcaatggcgctgcgtgcccgtgacctgtccctgccaagggcacctggagtacggacaatggccgtgcgtgctgctgacctgtctccgcgcagggcacctggagtaggggcaatggccctgcacacccatgacttgtaacctcgcagggcgcctggagtaggggtaatgtcctttggcacccgtgacctgacaccgcacaggacacctggagtaagggcaatggctccgcaagcccgtgacctgttgccgcacagggagcctggagtaggggcaatggctctgtgggcccgtgacctgccaccgcgcctggcgcctaaggtagggtcaatggccctgctcgcctgtgacctgtccccgcacagggagcctggtttgggggcaatggacctgcatgcccatgacctgccaccatgcttggtgcctcgagcaggggcaatggccctgtgcgcccgtgacctgtcactgtacaggcagcctggggtaggggcaatggccctgtgcgcccaagacctgtaacctcgcagggcgcttggtgtaggggcaatggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctctttcagaatctccagggccacccgaagggttcctctgtaccccatcttctctctgagtggggcaccgagcttcgtctgtgctgctgcagaggcggcaatgtcttccatctcaaacttagttggggtcttcacgtctgtgcttttcaccttgatt

SEQ ID NO: 2569 - DNA, 1950 bp, artificial
  synthetic oligo
gaacattcactaagcccaactcagttttgtgagtgaacccaagttctcagactattgagtgagtaggacaatgtgttgaatattttacttcaaaatgaaatcaaacaccacctgcacaatgagactaagcagatgaacataaaaggaagacaggataaatagtgagtctacaatctataacatcacagtccattttaggtccctaaagacattatcagtagagcattttctatttttggtatataacttttattctattccatttgctctttagttgagggatgaaggaactagaagaccgtgagcttttatttctcccaacgacagccatgatttgggggataattattttggaagccctgtgttaattcctttctcaagtgagggttcatttactttttaggaacaagtaaaagaacacagtcctcagcagctcttctcaaagtggggtccgtttcctgacgtggtccccctcccaccgagaggcatgcatcctccctccagcacccctccctagcattaccagagctttgtggagctcccgtcggctgctgggtgtgtgattttagaccttcccccaaacaggtgtttccttcaaaggatgagctggcggcatcctttagtacaataaaggcaccgtgtattaaatggtttctctaaaggaagtacattcttgtgtattcctacaccttccctttgcgctggtgaattgcacataaactttcaacgtaactttagagacaggtctacgctttcctagggtttgcagtgcacttgtagcaccattgggtgagaattggtatcggtccagttttccccttattctgttcactaattgcatgcatcagtagaggatgcaattagtgaacaattgcaccgctctccgacctggagagcagagccgtttggtagacaataggaacacaatggcccgccctggtgaaggagcctgtgtttttcgcttctgtcatcgagaaggggccctcactgattttcactcaattcacctcatcgtagttagcggagtgagaccaggaaattcaccttttacagaacatgggtctcaagggtcagctacgcaggatgagcccagcatgagtcccggcctgctcaaagtgacaggaggccttccagtcctacccatggtagctcctcatttgccggcatcagatttccctctcctaatgtatgcatcgtacgttcttacaatgaggaggcgagcaaatttccatcctgaaggagacctgcgacattcctttgagttcagaaatccttgtggatctctgctttaaaggactgactcgggtgacaatgctctggctcaacaggtgtcacctcaggacagtgagtcaggacagtcaactcaatgccacacacattcacacacacacacagagacacatacttcctcacacacacacatccatacacacacccccaaacacacacacatcctcacacacacacatcctcacacacacatcctcacatacaaacacgcacacacatgcacacgcatccacacacatccacacacacacccccaaacacacacacatccacacacacgcgcgcacacacatacacacatgtccacacacatcctcacacacacacacccacacacatgcacacaccgtcacacacacacacacagacacacatcctcacacatacgccctcacctcccccccgcccccgacacagtcacatcgatagcagacacctactagtcttgacgttcctacagctattccagctgtccgctctgtaaatatccttgcgatgtgtgtctgccgccaggaaagaaacgtttaccttggttgtcatagaaaccgaagtgtcgtcccgaggttctgctggatgacgacttgctacggagagcaggaagcgccaatacatcccccgaggctcagcgtcgatctggagctcactcagtggcaccccgct

SEQ ID NO: 2570 - DNA, 7450 bp, artificial
  synthetic oligo
tacccaacggaaacgaagtcattatgtgaaaaagacagctgcacatgtatgtttatcgcagcacaattcacaatcgccaacgtgtggcatcgacctaagtgcccatcgactgatgagtggaggaagaaaatgtgtatatacaccatgaaatgctagtcaggcgtaaaaaaaagaacaaaatcgtgtcttttgtggcaacttggatgcaactgcaggccattatcctaagtgagctaactcaggaacggaaaaccgaataccgcatgttctcggtgtgagctaagctataggtacacaaaagtacctgatctcgtgtgttctggcggtgggaaaggtggcccctcagggaacctggctcccacgtccctgtgcctcaagggagaacagaacctgtgacgccttcacttgcctccctccatgacccgttctgtgaaacttcccctgcccccagcgcctaggccaaggagaattcccagccctgttgcgaatcctttcttggttcccgcgtgagattgagcggggtgccactgagtgagctccagatcgacgctgagcctcgggggatgtattggcgcttcctgctctccgtagcaagtcgtcatccagcagaacctcgggacgacacttcggtttctatgacaaccaaggtaaacgtttctttcctggcggcagacacacatcgcaaggatatttacagagcggacagctggaatagctgtaggaacgtcaagactagtaggtgtctgctatcgatgtgactgtgtcgggggcgggggggaggtgagggcgtatgtgtgaggatgtgtgtctgtgtgtgtgtgtgtgacggtgtgtgcatgtgtgtgggtgtgtgtgtgtgaggatgtgtgtggacatgtgtgtatgtgtgtgcgcgcgtgtgtgtggatgtgtgtgtgtttgggggtgtgtgtgtggatgtgtgtggatgcgtgtgcatgtgtgtgcgtgtttgtatgtgaggatgtgtgtgtgaggatgtgtgtgtgtgaggatgtgtgtgtgtttgggggtgtgtgtatggatgtgtgtgtgtgaggaagtatgtgtctctgtgtgtgtgtgtgaatgtgtgtggcattgagttgactgtcctgactcactgtcctgaggtgacacctgttgagccagagcattgtcacccgagtcagtcctttaaagcagagatccacaaggatttctgaactcaaaggaatgtcgcaggtctccttcaggatggaaatttgctcgcctcctcattgtaagaacgtacgatgcatacattaggagagggaaatctgatgccggcaaatgaggagctaccatgggtaggactggaaggcctcctgtcactttgagcaggccgggactcatgctgggctcatcctgcgtagctgacccttgagacccatgttctgtaaaaggtgaatttcctggtctcactccgctaactacgatgaggtgaattgagtgaaaatcagtgagggccccttctcgatgacagaagcgaaaaacacaggctccttcaccagggcgggccattgtgttcctattgtctaccaaacggctctgctctccaggtcggagagcggtgcaattgttcactaattgcatcctctactgatgcatgcaattagtgaacagaataaggggaaaactggaccgataccaattctcacccaatggtgctacaagtgcactgcaaaccctaggaaagcgtagacctgtctctaaagttacgttgaaagtttatgtgcaattcaccagcgcaaagggaaggtgtaggaatacacaagaatgtacttcctttagagaaaccatttaatacacggtgcctttattgtactaaaggatgccgccagctcatcctttgaaggaaacacctgtttgggggaaggtctaaaatcacacacccagcagccgacgggagctccacaaagctctggtaatgctagggaggggtgctggagggaggatgcatgcctctcggtgggagggggaccacgtcaggaaacggaccccactttgagaagagctgctgaggactgtgttcttttacttgttcctaaaaagtaaatgaaccctcacttgagaaaggaattaacacagggcttccaaaataattatcccccaaatcatggctgtcgttgggagaaataaaagctcacggtcttctagttccttcatccctcaactaaagagcaaatggaatagaataaaagttatataccaaaaatagaaaatgctctactgataatgtctttagggacctaaaatggactgtgatgttatagattgtagactcactatttatcctgtcttccttttatgttcatctgcttagtctcattgtgcaggtggtgtttgatttcattttgaagtaaaatattcaacacattgtcctactcactcaatagtctgagaacttgggttcactcacaaaactgagttgggcttagtgaatgttccctttttatctcatagatcccggtatgcggaagtagatcaatatttgcacatcgtgatctagctggatctgcaatatagacaggtaaaggtaaacctagacagacatagatgtagacctgtctagctatcttgctctatctctagccactctgctgtccatccatcatctctctgtcttcatccatctctatctttatctctatccatccatctatcacctatctattcttatcattcttcatatctatcaagccgctatcttctataaaattatatttatctatctctatatccaactgtctttctctctatatatctcttcatcatctgtctccaccatctatgtctctatctctggctctctattattctgaatatctatagaccttctagctaatatatatctttatctatctctatcttttatccatctatttttatctatccctatgagtcattcaacctcatcaatctatatccatctctacctgtatgcatccatctatctatctgtctatccatctgtctatcccccatctacctgcctacctacctacctacctctctctctctctctagagggagggaaaacaattgtgtttcccttagtacaaaatatggggagaaagtcaccagcaagactatatgcaaacccttgatagaaggtatttgggcgatgggccaacgcatgtggtgagagaacatttcatattttgatttcacacacttcccttctgatgatctctcttaaggaggcatggctttggccatccgaacttagctgcaatggatattttggtggtctgtaggaggcagtcccttaaactgtttcacacctgtaaagatgttgccagatgccaatactgaagaatattcaaatggctgtgcaaactttaagcttttaaatatcttgtagaaatatacatgtataaacaggacaaaaattctggagtgtgtggactcatatacttgcaataagcatttctgggtgatgggattgctgatgcttactatatttcctatttagaaattttagacatccctttagatgtttccctgtctatgtttaaaataagaaactaaatggagaagaaaacagcatttgtactggaagcagaaacatttgcaggaatgtgtagaggcagtgagcatggattctatgcatcaatgccaggctccttgagtttccaacgtgtgtgtgtgtgtgtgtgtgtgtgtgtgtgtgtgtgtgtgtgtgtgtgtggagagagagagagagaaagagagagaggaagagaggagagactctgcatttggggatgtgggtaggcattgacttgggcttgagggtgcccagtcacacctgttttgtgacatgggctggcaggtccagttaaggggagattgaagtgccagggtcattggtgattccttctcacttttgttcggggtcctcagttgacacttgtgcttgacaacccagtactctgagttctctaaagaagagggcattaaacctgtacgttcatataccctcgtctaagaaaggttttgtacaacttttccctaaagtatgtatatctcatcatcattatacatttcatattacatctaccagtgcccgtgaacaaagacacacatacatgcatttattaagaaaataattattggcctatgaaacctgtaatttgaagtccacaatgcatgagctaaaatatgtaagtgagctatgatacccaatgttgcacagtaccaaatattgtacaatggctatagaaaacaacaacaggctagcagagtatttcgatgtggaaggtgggaagtgaaggattgacaaaagagttgcatcttcggtgcacgtttctataatatgggacatttcattaaataaagtttggaactagcagggaaacctcactgtacagacgttcacacaaatgaggtaggaacacgggcattcacaggacaatgtatccagttatgctcttaggttaggagctccagttgaagatgatatgtgcatgtgtgtgtgcacattggcgcatcggcaatgccttggaagcgggcacattatcatgtagactgagattctgtgacgtgatgtcctttcatatgtctgtctacacatctcatattctatgctaacccatttcatgttatttgagaatcagaaaaacacagtaacatgacaagactcacctgtcatgtttcctcattttatcaatctcgttgagcacatttcatttctctctctctctctctctctcacacacacacacagagagagagagagagagaggagagagagagagagagactgctaacatggaatccttctgtcttagggggatgctctcgggaaagcactagttcccaaggttctgaaatggaaaaagactagcatacgctaagtggcataacagggaaattgtttgagatgcaaaagaaggcagaaaacaaagatgacaactacgtgatgcctgagatgaagacgtcagttctgtttcaaaagggcatgcattcaagagttggggaggggaacaggataaatcacttgattggcttaatttcctatctgtgtttgtgtttccaggttgacattaggagtgcataggtcctgagcatctacacgcggtgccactgggtcgccagaagaacagcgcacttcaggggcacagagtggggttgaagggtctgcacaccagcgcttgcagtgtgagcagcaagagatccagctcacagaaccaaacctgctgcgatccatgtgacactgggtaagatttccccatttactaaacattcacttgcattcacctcacgctgacatttcacagtggaattttccttgcccatcgttgtacagacacttgttttcaggataagagtcactgatttggtgtcggcaggcaaaagtttaaaaccacggtagagaggtgcagatggcagccagtgaccgctgcctgcagcgatcctcacgaccgatggtagccagtaatcaccaggatgatcgccacgcagctctgggttctgggtgctcttgcacatgacatggtgccgacacccagcatctgcatgtgggagacctcctcgggcttcctgggaagcacaggtccatactagcaccctagaaataaaaacatgaagcatttccccaggtttccgcccaaggagcccaaaggcacagaatactcagtaagaaatgtggggtccctgctggtacacccacctccccatgcaggtgctcctcaagatggaattgttaaaattaggagaaggccttgggtttgctgtgtaataaagcttctgtggaccttctgtatgatcccaaatacttgccatctgtctatccctctgtctaagactcacttgtcacgtttccttattttatcaacctcactgagcagggtgcttcgcgtttcacgaaaggatgctttcctgatacatttccgctctccctttaccatgttgcagcatactccagaattgtccattggaaacacgagttcaagtgcctcagggagattcaggaggaggaacacagcccacccacactgcaccccctttgcagtctgaaggcaaaggatgctctgaagagtagcttggtttaggagagacctacggtagcagagggtgtggcaggcagacccctcggcctcccttagctaccttttcccagctcatcatggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccattgcccctactccaggtgccctgcgcggagacaggtcagcagcacgcacggccattgtccgtactccaggtgcccttggcagggacaggtcacgggcacgcagcgccattgcttctactccagggaccctgcagggaaacaggtcatctgtgtccaaggccattgcccctgctccaggtgccctgcgtggagacaggtcagcagcgcgcacggcctttgtccctactccaggcgcccttcacagggacagg

SEQ ID NO: 2571 - DNA, 1150 bp, artificial
  synthetic oligo
tttcttatctgcctatctttgttctgtgacctcccaattttcttctatgggtgctagtcctcctttctttctttggaatttcccaggactctctttcagggcactggactcgtggtgtgttttatgcttgcagtctgagagtttgtcctcagagggagagattttccactggggtcctgagcatgcctgggtggtgtggtagtcccctgcttatctgcagtttcactctccacagtttcagttacccgtggccaacctcggcccaaaaatattaagtggaaacttccagaaataaacaattcaattaaataaaccattttaaatggcgcccccttctgagtagcgtgatgaaacctcaagcctgctccatcctacccgaagcgtgagtcctcccttttatccagccataatttctgcagcttcaaaaactagcacaaatttcttattccttcttcacagtttcatggatggaagatttgttcttactgcagctcttagcaacctcaacgtgtattttagggccattattaagtaaaagaaaacacaagcactgtgataccgggagagtcattctgagaaccaaggtggctactaagtggctaattggcagggaggcattgacagcgtggagccactgtacaaagggaggattcacaggctggacaggacggaacaagactttatcatgctactcagaggggtgcacaatttaaaacttttaattatttctggaatttttcatttaatatatttggaccacaagtcactgaaaccacagaaagtaaaacagaggagaagaagagactaccgcctttgggaaaagggtctttgcagatataattaaggtagagatgtcgaaagtaggtcattctggattagcgtgagccctaattcaatgacaaggggccttgtaagtgacagaagaagagaaagacatacagcagaggctggagtgaggcagccatcaagctcaggatgcctggagccttctggagctgggagaggcaggaaggagccttccctagagcctctggggggagtgtggccctgagacacctggattttgaacttctggcctctaggactgggagaggatccactttctctgttgtgagccacccagtttatgatgctttgttctggcagccac

SEQ ID NO: 2572 - DNA, 2000 bp, artificial
  synthetic oligo
cctctggaccccagctaagacctcttgggaacacccagacagcactgctcatccgggctggggaggagccccaggggacctctatgggccttgcctgacctaggccttcggggcctgcaggggcactttcaccttccccagcggcaggggctccccttgcagcctctttggtggcagaagcggcctcggcagcatcttctgctccgggaccagcctcgctggcattcccctgggctggggaggcctgggcagcagctgggtcttcactctccactggggccgctgcccaggccacaccctgctggctcctcgctgggaaggctgcccatgcctccatctcccggatgagccggagcagccccaggaagccaggtggcctcttctccagctgcatccctctcagggtatcctggagtgcctcgctggggcgggcccaagacagcacctgctgtagtcgcaggtaattggccaaggctgggcagacggcccccttctccacagccctctgcagcaggccttccaggcgcaccacgaaggcaaacagcccctcctggggcccctgcgtgcaggtcaggaacttcagcctcgaagtcattcgagtgtcctggttcctaaatacctgccccagcgccgccaggcagtccagcgcggacaagttggtatcttcctccaggaggccgctcacgacttccagggccgggccgcccaagctctccagcagccacctcttcttctccctttccgacgcatggcaccacagctgcagcatatccttggcatgctccacccagctctcaaaggactcttcctcgcagcctggctgctccctcctggaaaagggtctcaattcccggtaggccctgttttccagcacaggctgtagggtgcagcgccaaggctggacccaggcttttgttacatttgtccctcctgcttcacccacagctcctgcctcacctgcagctcctgcctcacccacagctcctgcctcacctgctgctcctgcctcacccacagctcctgcctcacctgctgctcctgcctcacctgctgctcttccctcacctgcgcctcctgcctcacctgctgctcctgcctcacctgcgcctcctgcctcacctgctgctcctgcctcacctacacctcctgcctcacctgcgcctcctgcctcacctgctgctcctgcctcacctacacctcctgcctcacctgcgcctcctgcctcacctgctgctcctccctcacctgctgctcctgcctcacctgcgcctcctgcctcacctgctgctcctgcctcacctacacctcctgcctcacctgcgcctcctgcctcacctgctgctcctgcctcacctgttgctcctgcctcacctgtgcctcctgcctcacctgctgctcctacctcacctacacctcctgcctcacctgcgcctcctccctcacctgcagcttttgctactgcttgaccctggggctgtgcaggaaaactgggcatatcctgaaactcaataacaggtacttggggcaggaagatcactttccagggccccccattgcctggtatttgatggggaatcaagcttcggtttaaatactcagcgaactccaccaaggctgccttggccccgagctcctttctgaagtgcttggtgagtactcggtacctgcccaggggcgacagggcagcccgcacggcctcctggaactcatgttccttgcagtcatcagggatacccaggatgagcagggagcgctctgcgttcgcacccatccacctgcaccagtcccgaagcatcgccagagccatcgcagaggacttgagggagggagcctgatcaatcaggaatgtgtgctgactgttgcagtctccgacacagcctgtgagtgcaaagagagaagcttgtttgtgccaaacactcactcccaccactcatctgcccctacgtgtgtgggggtgagggggcagggctggagttcctctgcctccttgttttgtcgct

SEQ ID NO: 2573 - DNA, 1050 bp, artificial
  synthetic oligo
ttgtatttttagtagagacgggatttcaccatattgatcaggctggtctcaaactcccaacctgatgtgatccacctgcctcagcctcccaaagttctgggattacaggcgtgagccacctcgtccagccacctggctgattttttaattttttttttatagagatgaggtctcattatgttgcccaggctccaagattttttaagtaccattttctgaaaagggcttctgacagaacctcaccaagaaccagatctgctggcaccctgacgttagacttttagcctccagaactgtgagagctcaaatcaaatcaaatcaaaataagaaagtaagaattaaatttttttcatttttttcaatgaaaatattcctcgcctactatataatgtattctagctggttacatgagaacaaggtgagaggaggtagagaaggacaaaggaggaaagaggaaagcacaggtgagaaggagagcagcttgactgcagtgactgaacactcagatcacagggtctcctctggttatgggaatgggatgcaggaagaaacaaacacagtatatcagttaggaaagtggccacaaaagtagtagaaaacctaactatggtggattaaagaattagatgctttgttttctcacctaaggactctggggtagctttctggcatcggttcagcagcagagcttttggcagtacgcagcatctttctgatttgcttcgctttgctgcgtgatcacaaaatggctgctgaagctccagccatcacatatgcattagacagaaggaggaaggggcagagacagacactctgtcctcttttatcaaggaagcaacagttttcccagaaacttgcctggcagacttccacttagatctcaggagccagaactggatcatgcggccacccctaacctcaagagaggctgagaacgttgggaatgggatggattttcatgacctatcacctggggctgagcccactgatgccttgaacaaagttggggtcttatccccagagaaaaaggttaggatgcagattgggtgg

SEQ ID NO: 2574 - DNA, 2950 bp, artificial
  synthetic oligo
gggcagaaggctgcccgcccgccagctctgctcgctagcaaggaagcactgttcctagagcacttcagctgggatcaaagtaccttctgcgctgcagagagagcccaggcctgaggaggggggagtgggagggggagcagaagggggaggccctaggactgaggtactgcctgtctggtctgggagtggcccccaaattagagggccaggccgagtgactcagtgggccctagccaggccgagtgactcggtgggccccgggccgggcgtgcagttatggcttattgcagactgcaaaccacagatacaaaaaccttccaggtacaaggaccgtatttatatgagtattgcccccagaagcagcccccaacttcaggtaagagctgcaaggtgcatgcataatgtgtctcccccaagcagggtgtcgcctcatcgccacttccaagcccccatccaggaacatgcctggctgagacctgagggtgaggtcggtgcagggccggactgcagcgccgcctggctcccctgtgtctccccacacccccccgcacgtgtgctcttccttccaccggcaacttccctcttccctactggtctgctccaggtcacctcctccaggtagccctcccgagcctctggcactgtgcatggccctgcgcccccacggtattcagagctgtttcacccccactgggactcctggaggctgaggccctgagtgacagctcctgggttctcagtccccaagcagtgcaggaaggtactgggtaccagcacctcgggcagcaggcatgccttgagtgggtttctccttttttctgaaacggctttactgagagtggctgtgcttaccacacgatttgcgcattgagcacgtacaaggcaagggcttttatatggtctattcacagaactgtgcaaccatcactcagtcgattgtagaacattttcatcacctcaaaaagaaaacccatacctttaggtaccacccctctagcacccactgcccacaaatccgctttctgtccccacagatgagcctagtgtggacatttcaaatgaatggaaccagaggctctgcggccttttgcgactggctgctgtcactgagcggaatgtttccaaatgcttctctctccacccagactgctagtcaggcttcgctgcctgtcccgctctctaccgacatatttctccacgaatgagttggcagtgggggagggaaagagggtgggacagagatgagaccaggctgccaagagtcggacgctgaggctgggcaaaaggtaaaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggttgaagaccctcagccctcgacgttgtcctctctccattggatgccgcctctctctagccacccctctctccctctctgccccttcgagctttttctctcaatatgcaattttctcttttggtcttccgcactcttggcccccagttctattgcagatctgtttctcactccatctaaactcttacccctgtgtctcaggagctgctcttgctgagggaagaaggggacactacgggacaggggggcagtgtcgtactaaggacctgggctctagccactggaggaactggactcatttgggccctcaggaagcggctgagtcttggtggggtaacccggttagcccccgtaagtgaccagcacagggctgagcccagaggaagtggccacccacagagtggttctcatgtccgaggggacctgcagggattgagcaagaagactgactcgctggatccttcgtctctgaatcagttcagggcaggcaagctggggagccccctgccccgtcctgccaccaccagccggatcgggccctctttttaagggaagaaagtctggagtggaagggagggcacagggcgccaggagcctacatgaagtccttccagaaatccacaacagctacctctctgatcctggagaaaccacctccttgcttaggcccaagcaggttcctggcaggctcaggaccaaattccaggggccactcatgggcctagcagcccaaggccgcctccccctcgtctttcttccatctctctttcctctgcctggcgagatgccagccagcacctcagtgtccccatctgggcagtggaaagtttgactctctgggtccttgtttgagtgagtgcgagtgtgtccgttcctttgctgtctgccccaggcgggggagggggggggaggtggtgggggcgagggggcgggggctcagctagtccagccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcag

SEQ ID NO: 2575 - DNA, 2000 bp, artificial
  synthetic oligo
acagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtgcgctgctcctgtggcggcctggcctctccgtgcccctcctggcccttgggctccttgccctcagaagaggggccccgtcaccctcagaagaggggccccgtcaccctcaggtctgggctagcccggactagggaggtttcccctcccttctagacacttccatggccccagctgtcctgagacgcggctccagaatccaaccaggcctgaatggcacctgccctctcagcgtggagcgtttgccaagagcacgccgactgcagggcgccaggctagagcctggaaatctaagcggggcccggcctgcccagctccatggagtctagggttcacaacgaggcaccgccaaaacccagggggtgacacaggagggaaggggcccaatggagccagggcagggtgctgtgtgcacccacttgcactggcctggccttggctcccctgccagccccctggcaggtgacactgtgtgtaggcagagccgagcctgggctgcaaggcattcccacacacgcagcatccagagagaggatccaggtcagggccgggaaagcctgcatgctggggacacaggtcgtcctggaaaggacagcttggagggggacagtccccagagcaacgctaccgcctgtgactttccttcggccctgcacgaagagcctcagagcaggtggcgggacctggggcttccctgggcagcccaggctcccaacggaaatagagtgggcagggcccgcgtgaatggcagcctggcactgcgtgttggctcctcacacataactgcgtctttatggctggactggcactggcgcactggcatccccaggtttctcctttctgggataggaggtgccacacagtgtggtggcccagtgatagaaagtcaccatcagcatcacagcactattctgggccatgtgctctacggcccggcaatg

SEQ ID NO: 2576 - DNA, 1950 bp, artificial
  synthetic oligo
atattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcac

SEQ ID NO: 2577 - DNA, 5400 bp, artificial
  synthetic oligo
ccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctcatgtaagagtctaggtgggcaacctagggccagcgcaacagctacttagccctcaggaatctgagctcctttgattgtgtcatacatggactccatgtgcaagatggcaacagatagatagctgcggccgcacctgtccccacatcagcattccagctggcaggaaggaggggaagggcagaggagaacacattccttctctttaaggacatggcccttgaattcgtccctgtcacttttgctcatacccagttggccaggacagagtcagatggtcatggttagctgcaagggagttgggggaatgtaatcattagctggatgacaagacacttagctgaaaattaaaacatgacgtaggaggtgggagagtagctagcaagtttctgccacacacctctgcggattcattaacacctcctcaagacacatttgagaagtggaaggtacccatcttgaggccaggctttccccaggtgacctggccagcccttctggggatggaatggggtcagtacctctgaagaagtgcagcaaaaagaggggccatttgtgagcaagagggcaggagcagtggtgatggcctctctccactgatctgctcctgtgccaccaaatagggtacccacctggctgggcaggatatgggtggtgttaaaagtcacagaggctgcagggtgggggtagggtgtgtggggaagggtctgcttgggtttccatatccagtaggggggtttcctggaagttaaaatccatacaagcgaactgctggctgattgggctggtcaaggcagtgaaactcctgcaatcacggcgtgtggcttgggcaccacgggaggccattcaggcccagtgtccaccaccctggacacagggcgaagtggctggtgggggctgcttgcgtgttctattgtggtggcatagacatcacctaaaatgtaccacgttcaccatttttaagtgtgcggcccaggggcagaagcacattcatggtgctgtgcagccatcaccaccatccagccgcagaacttgttcgtcttcccaaactgaagctctggccccgttcaaccccaactccccagcccccagcccatggcacccacccttccactgtccgtcccctcagatttcacagctctcctatgaggccctcacaggagtggaatcctacagtgttggcctctctgtgactggctccttctactgagtccaacgtcctcaagggtcagccatgttgaagcccgtctcagaatggccttactttgtaaggctgagtcctattctatggcctggatgggccacatggtgtttatccagctgcctatccatggacattgggttgcatccaccttttggctattgtgagtaatgttgctatgaacttgagtggacaaatacgtttgtgtccctgctttcaattctttggggcctaccccagcagtggggtgggtgggtcctatgggaattctactgctttccacagtggctgcaccgtcttccattctatggcggtgcttgtttgaatgagaattctgggccagccctggagcctctgaaggcaggcaaatgtgtggtctcgagcttgactagacacccagatcccccaggggttggggtgctttatagcgttctggtcctcccgcttctgaatgggaagctctggacccaagactctgtattcgtgaagttccctgagtggggaggggtgcccacccaggtctggcatgggctgccgtagattagagtagagcgctgggccacctaggggccaggagtgctgcagaagtgcatccacccaaaggcgcaggctgaatcgggcaacctcctgggctcctgccacctccagggtgtttctgtgggttccagaatcctccttgtctggacccttgttaacgaggacttccaatgcctgtgtctttctgcggcacccggcgccggacaggcggttgctttggctttgcacgcagctgccagtgggtccccaaggtggcccctccggggctgccctgcagggcagagcttcaggcaggtgggtgcatgcaggagtggggagggggcgccatggtgatggctattgtttttgcccaaagctgttccaggcatgagagccacttgtcatgtgtacagattgtaccaggaacagggggaggaaggaacagagcactgggggccggtggggggcagagggggagcctgtccctttaaatctgttttctcgggttttatttccttctcttttcccatcctcctccctccaccagcacaagtggagccgtgagggcccaggagctgcagcgacggtgcctctgaaatattaatgaggctgttctctgcctcagctccttccctcccccttccctggctgcatgcaggccttgtccttggaaccctcctttcccctcccaggtggtcgccaaggtgcgtcaagcagaggggagggggcaggggcgggcaggaaggagagggcctggcgcaagggcaggaagatgtggggaatcagggataaaaggggtctcccaggtgcacaccagccaccagcatctcgacctgcctaggatcatgccaggcccaggagagggcagggtggctgccagactgggcgccctccttccgtgccctctccccacctgctccccagctggtctaggggcccaccccgggcctgacctacgaggcctgggccacacctctcgctgttgccttggcttgcttttcctctctgggttctgccgggcctggcctgtgttctaggagcctggaggtggagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttc

SEQ ID NO: 2578 - DNA, 2550 bp, artificial
  synthetic oligo
ggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaaggga

SEQ ID NO: 2579 - DNA, 1850 bp, artificial
  synthetic oligo
gctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagc

SEQ ID NO: 2580 - DNA, 1700 bp, artificial
  synthetic oligo
agcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaatt

SEQ ID NO: 2581 - DNA, 9400 bp, artificial
  synthetic oligo
cggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggta

SEQ ID NO: 2582 - DNA, 5450 bp, artificial
  synthetic oligo
tctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattc

SEQ ID NO: 2583 - DNA, 3300 bp, artificial
  synthetic oligo
gccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaa

SEQ ID NO: 2584 - DNA, 1950 bp, artificial
  synthetic oligo
tattaaaatcccagctggcttaaattaagaaagaaagaaagaaaaataaagaagaaagaaagaaagagagagagagagaaagaaaggaaaggaaagaaagaaaagaaggaaagaaaggaaagaaagaaagaaaggaaagaaagaaagaaagaaggaaagaaagaaagaaagaaagaaagaaagaaagaaagaaagaaagaaagaaagaaaaaagaaagaaagaaaagaaaagaaaagaaaagaaaagaaagaaaagaaaatcctagctggcttttgtgcagacattgacaagctgatcctaaaatgcatatgaaaatgcaagaaactcagaatagccaaaacaatcttgaaaaagaacaaagttatttttcctaattttccaagactcacatttcctaatttcaaagcttaccacaaagctacaggactcaagtctgtgtggtactagcacaaagatacttatacatcaattgaacagaattaagaattcagaaataaacccttacatctatgatcaattgatttttgccaagagtgccaagaccattcaatggcagaaagaatagtctgtttaacaaacggtgttgggacaattagatatccacatgcaaaagaatgaacttggacccctagctcagaccatatacaaaaattaactcaaaatggatcatagatctaaatgtaagagctaaaactataaaactcttggaagaaaacacaggagtcaatcttgatgaccttggcttaggcaatggtttcttagaaaggatgtccaaagtgtccaacaagcaaagaaaaaactaaattggaaaatgaaaaactgttgtgcttcaaagggcaccatcgagaaagtgacaaggcgacccccaaagtaacagagcctgtttgcaaattacacagtagctgataattgacttgtatctagatcatataaagaaccaatgcaactcaataacaaaaagaaatagcccgattaaaattaggtaaagggattttgttcaccagtaaagggattttgttcaccgctgctctgctcatgttgctactgcagttccgaggcagcaggaagagatgcggcccctggatgtcgccgagctgtcagaaccggaggaagtggaggtgctggagctggaggggggttttgagcagtttctgctcccggtcatccatgagatgccagaggacatcgcgtcgctgacaagcactggcgggcgtacctgtggaagcggagcacgctgtgggagatggacaatatgctcttccagatcaaaacccaggtggaggcttcggaggagcatcctcaaccgcctccacaacccgggcgacgcagtggagggcagggtgaccaagaggtgccagaaggccgaggagaaggccaaggaaatggtgaagatggcagagatgctggtggagctggcccagaggatagagacgaacgagtcgagagcacggtcggtggtttacagccaatggattctggtaaactggtggagattggctgacacccagaagaagctgaaaccagagagcctttggttttctctattttactctgtccacgctctgtcctcactcacactcagttctctgctatggtctgtggttgatgaactcaatatgagttttgattgtttgtgtttttgtctggggaagtaagtttatttggaaaatgctctctcatacaggaatgagggcctagaccacgctcttgcagcagtcacatttgttcctgggctttggttgttatttctaaatgtttgaggtgctttgctctttcttgtgtgatctgatagctccctggaactttggatctgtgtgtgacacatgagcctcattgttggagttctccagctctggaggggctgaaggagccgcaatgattctagaagatgactccatacagcaactactgaagaaaggaccagacttcagctgggaatgtggatgggc

SEQ ID NO: 2585 - DNA, 3800 bp, artificial
  synthetic oligo
gagggtggcgggtgaaaaggagctgccggggcagcgggccgccgcgagcccctcctgggatcttccgccccaagcccagcctgcgattccctccctggaccccttctccttcctctccgaagccctccctggaaggagccccgcatgctgaccgcagctgccgctagggggcagagccgtctacaccaaaagccacaccgctccagcgtgcgcgtgcggggaggtgcgcgagcgcgtgtgcacgcacggcgggggctcgcttgacgctgagtccggcgaactaagctcgccacccccaccccatccccctgctgctgggagccccaggcagtccccggccaaggcgctccaaaaggtcccctctgttgaggactgggaagcagaccccgccccagtgccccccaaagcgcccgccctcccctggtgtggctggagaggggtctgatccggcggggctgagctcggagctgggtctcctccgggcccggggttgcggcggggggcggtcactccccctccctgcctcagccccgcaccctccacgccgtgtctccagcatcgaaattcacagcaaaatacacaactagtgaagaactgggctcgggtcccagaaataggctgccctttccagagggtgacgggaatatcctccctgcttcccgttgccatggtttccgctcagccaccaggcagcctgttgcgcggcagccatttgccgcgacgggatgctgctgccgctggtgtgcagcaggccgccacgcgaggaaggggacagactgccctggagacccgcccaccacggagaaaaggccacggatctaaagacaccggagggcggctacgcgggccagatggacaaatgctagagtcagcacctgtctgtgggggcgcccttggcctgggcgctggacctaggccatcaggactggagagccttcttctcttctggccagagaaagagcaaagggtggcttcctgacaggtccggagctggcacagcacaacagagcctagaaaatcactagcagggctgagctcggggttccaccgctgcagccttcctgttggacccagtctgctcaaggactccctcacagcccagtgctttctgttcaccccggggcgctcccagcccagcctcctagcctcagtgagtgggaaatgtctgtactgcccacttgtcctcaaacgcatgtccttgctcggctgctccctgctctgccccatctggaggggacagggtgaggaggcgccctggaggcctggccccagcttgggcaacacagcctagcggggtgatcacacctgggtctgcagcccctccagcacttcctggggctgtgccggccattccagaccattcctgttggtggaactcatgacagggcttgtttacgccagtcactgtgttctgacacctcccccaccccgatcattaacttttctggtccttttcagttattaaaattcagcccagactcacatcccatgggcctcccctccccatccttggggctggaatggactggaatggagaggaggtgacctgacctcccttccctcccttcccaccccccacccccccgggccggggcaggcagaacttgtgccagggtgagggggtgagaggggccccatctttgcctgggctttttgatgcctgccaatggggtcgcccttttctgagggcaggctcagccccttccttgctgaggctaaagaccctctgggattgggaagcgctgtcctctctgggccccaccagcgtctaccggaccccctcagacctctggcccccacaccttgtgcccccagggcagaaggcagctggggtaagagtgccttcagtcctgccaggctcagcaaatgtcctgccttcagaaacctcagcaggcagacaggcaggtgcctcctcaggaatacagcgtgccccccatccccagggggacgtacccagctctccccacagcctccggggactgcgggctgtgtccacagctctggcagggccttattttctcccagctttttggcattttatggattaaaaacacagcattcccctaagggcagcctgcttccgtccgggcttctgtgggagtgagtaaggctggtctcctgagggaagtgtgtgattcttgccggggccagaggccaagacgagccaggagggcacttacccctttggggcatcttgcccttgtcctttctgttttctctactcaggcctctcccctgagctgaggaaaccaagagaattcttgtccttttggataaagaccttttcctaagatcgttttctcctagaaataagcatactttattaagatattttggactggccgtgcacagtggctcatgcctgtaatcccagcactttgggaggccaaggcggcggggatcacgaggtcaggagtttgaaagcagcctggccaacatggtgaaaccccgtctctactaaaaatacaaaaaattagccgggcgtggttgcacacgcctgtaatcctagctactctaggaggctgaggcaggagaattgcttgaacccgggaggcggaggttgcagtgagctgagatcacaccactgcactccagcctgggggacagagtgagacttcgtctaaggaaaaaaaaaaaaaaaaaagatattttggactgattttgtgtgtcctgatgcagtttttctttgtgcattaaacatagtgaaacacacagtgcagccaagtgtggggccacactgcctcgcttccctcttcccctcacagagccgggcacgacagctgcgggcacagggagcaatcgcctggagccagagggggcaacgccagcccaagggcaaatgggcaaccctgtgcaaaaggctctggcaaccagatcatctactttagaagaaaggagaagaaaaagagcccccaggagaggaagtagcccctaacccgactgacaagcaatccgttcgcaaagacagaagggccttcagtgaattggtttcaaagtgcttgatttcttaaaaccagaacaattgatcattagagaactgattaagctacagccgctgttgaataaaaggtaaaaataaactccttcatttgaattccaaattcaggcttggaggtgacctagccatgaggcaaactggctgtgggtggacagggctgcacacggagctggtgggtggacgtcacctgaagtcttctctcctcccaaagtgtgggtgctgggaccccaagggcacagtgtgaatgtccccagcacttaacaccagggtagcccaggtacagaggctgctgaggggctggtgcaggttctccaagggccactgctatgcccagaatgagccactagttctggatcaggaggagcagggggtgaggaggggggggggtcccaaaggagagaatggttcgggggcagctgcaatttaccaacgggtacagaagtactttgacatcttagccgcaggcacagccctaccagtgggtaccagctgttgtgaccagagatggcagcagtcagagccagtcctgggacccaatttttcccctcatctgttacctgggggggtcaccagggcctaatgaagacttttgaggtttctcagccacaaaaggatcacggtgcctctccatatggaattcagcagaactctcaccttttaaaacggtctagtagatactgagtagacacaaaaggacatttacaaaatatgtgtaagtgtaaagaacaatacaacaaacctctgtgtactcaccaccagcttagaagaaaggtaacgttccctttgaaggaccttgggtgac

SEQ ID NO: 2586 - DNA, 1800 bp, artificial
  synthetic oligo
acacgaaaaggggctcagcatcaccagctgttagggagacacaaatcaaaaccgcagtgcggtgcatcacacacctatcccatggctgaactaaaccacagcagatgccggagtgggtgtgtggagaaaccagcgctcacccatcgctagtggatatgtcaaaccgggcagccactcgggaaagcagttggcagtttcttacaaaaacacacatctataaaggggtagcacggggtagcagagtggtgaggaaaccgctctgtaatttgattgcactggcagttccatgaatgtacacagtgatgaagttgcatagagacgcacatacacgagtgtgcgcacacaggagacacccgagcatcgatgtcgcgtccaggttccggttgtgcctcgggcgttcaagtagccaatgtcagagggacctgtggggaggggccacagcctcccaggcacttcttaccaacgtcctcgtgaatctaacagtttaaaaagaacaagttaaaaaatattccggcagaaaaaagaaaagtataaatgaaaaatgtgggcgaactgttgatgccagctgatggatccacagggtttcatgaactctgtctttgtttatgtttgaacttttccatgataaaccatttcttaagagtcaccacgaaatgagtgtctggtgaataagtgaagcattcatgaatgactgcagtccaactctgtccttccagagataatgcgagcgagatcccgcaaggggagatgattgctcaaggtcacgcggaacagtcaaggctactgagattccgtctagctctttctcaatgtgtgtttttaactttacacaagcaggacattacttttaaaggaaaagtgaccataaactgagggctgcaacataggaggggggaagggcagagggagacccaggatgccagcttcgcctaggggcaggggcgaggcagacagcctggggaggttagaggctctgctgtgagagggtttctgcaagatgaaatcactcaaatgccggctgtgtttggacatcttgagagaacatttccacacacggatggggtctagggttgagttcgtgatacgagcaaacagctacccaaaggacaatgattaactcctgggaaaacaaaatgcagctcgcatggccccaccgtgagcagcatttatgtggccgcataatttccaagcatggggataggaaggggtagaacagcaaaggtttgggggatgggactgatggaagccttcgaggaggcccccaagacgtgggcggacccttgtcttggcacactcctgcccctacatccttcgggccccagagctccctgacaccactggacccaccgccccccaccactctgcttcctgccagccctccagatggcctgtccttgccccctgtgtttgctccctcctgaggtcagcccctctgcaaggacaccggcccttcccctctggctaggttaggtcaaggacttggcctctccaacgcccactcctctcagtcacaaacagggacacctcaggcaccaacctgtacccgagctcagccacggacacatctgggcccccagaagggccctcagctctccagagccagagcaggcaagggcgacagagcgtgtggctttggcggctgggccaggaggagggaggggtccctactgcagggtttagccctttcacacttcagcagagagcagccgccccgtcagcacccacctgctgctgtcctcagaaatggggtgcctgtcggggtgtgctggtccccaaaagatgtgtccacattctggagcc

SEQ ID NO: 2587 - DNA, 2100 bp, artificial
  synthetic oligo
ggcttaggggaagggcggggatgccgctcagggaacctccggctgcagggagcagggcccccagggggcccagtgcagggacagcttcggagcccctttcctcaagcagaggcagggaggtgcccagtggccttcggctgtgtgtcctggtgcccaagcttgccccttcaccggggcgctgtggctggggcctgggctgttgagacgttgtggggtgactggtttgtgcccccactgaaagatacatccatatcttaacacccaggccctgtgatcagggccttatatgcaaataaagggtgtctgcagatgtcattaaattgaggatgtggagatgagagcaacccagatgatccagggggccccaaatccaaggacagtttccttagaagggacaagagagagagacacagagaaggccatgtggaggcgaaggtggggagtgcccagggcccccagaagctggaagaggtgggtggatccgcccccagagccaccggaggaagcactcgattctggactccggcctccagaactgggagagtcaattcctgttggctgaagccaagcggtttgtggtcatttgctgcggcagcccaggccactccgacacgagggaatgagctgagcccagagtcctcctgggccgtggaggcggggggcggggggacctttgcacccgcatcgtccagtaacctggtgggggctggggcgaccttgggaaggcagctcccgttgtccttggctcatttccagagagcatgagcggccaacctgaatggaggctggggagtgagccccttaggccgggggcccctgggagtgcaccccacttccaccgcaggaggaagggccgtgtgcagtgggctgcgggtcccacacaagcctagaaatgggggagcaggggccaccgtgtgcaccattgttggcaccgcgtgtgtggacacattggtggtggaggcagcagcgcggtcagctgaagagcgcgacgcctagagcaagtgaagacgaccttgacaagcccatgatcctgtcaggagatcaatctcccttccagcatgttttcagttttttactgtaaagaattgcaaacacatgcccaacctagagaggatgacagggcacaccggccccgccggcggtcctcacacagccctctctcctctccactccccttaatgtggccccgaggcctggggcctcctgagagaggcacctccatctgccttaagcagggacagggccttccaggcagcaaacccgggttcagaacctggacccttgtctacaccagccagggctggaggttggccctctcagcctggggactcataggggtgcccgaaactccaggaatcagccccctgggcccccactgggccaggtcaaagtcagtgtgggtgggaggtatttgcaagatcgccatgcaggaagtagggtcccagggagaggacaggcccagacagccatcgccgcaggcatctgcccacatggaaagcaaggcggtaagcagaggcgatggaatgtgtgtcaacaccgtgcaaagggccagtgtggccggggctggggcagcgagggcggcagccaggggcctcaaggggcgggcaagaggcccgggaggctgggactgccaggaaggaagccagctgctcagcctggggcgccctccccgaggcctgcccgctccctaccagccagacttctagccaagctccagagctgggagcccagctgcccacctagcatctcacagggatggccttgcacactacacacctccacccaagtggagcaattctgtacattcaagtacaattcagttgtacaattctgtacaattcaagtacattctcaagtgtacttgagcaatttctgatgccgagctcccctgccgcgccacatctatagtggctccaggtgcggttgcctcttctctccacacccctcccgggagcacacacgcaggcatgtaggctgctccaaggggttctggaaggctctggccctttcttcttcagcaacctcctaaggggctgggtgaggagtgagcggccaacacacatacatgcatacacacacacgtacactagcctctgcatt

SEQ ID NO: 2588 - DNA, 3900 bp, artificial
  synthetic oligo
tccaaatgaatcacagcaaaatctccaaacaccaggaaagtaaacaacatgcttctaaatagcccatgggtccaagaggaagtctaaaggaaaaactttttaaatacaccaaaatagtcaaaaacaaaactacaaaacaggaaaatttgtgggatgcagctaaagcagtgccctgggggacatttatagcacaaaaagaaaggcaattttttctctccctaaaaaggaatcagtttctcagaggcaggttggtgcatgggagagggttgacttgaacaatatctggagagctcaaagctttcaaaaaacattaaaccctgaatatatcgggaagctggaagatgttagagcacttacatttactttcctggatccagacttcacatcgaagagtttaattgaactctgggtctacctccagctggctgaattagtctgaacaagaacaagtcattcagatgttcagagtcttcatttcctcatctgtgaaatgctaagaccctcaacttcacagggatctttttgagttaaacgatagagcacttaagaaagcttcccgaaactcccgaagcactgcattcatttgctagagctgctgtcaaaaaatgctgcacacgggatgtgtgaaaacagcacacatttattctctcccagctctggaggccagaagttcaagatcagggtgtcggcagggctgtggtccctctgaaggctggagggaaaggtccgtcccaggcctctcccctggcttctgtcgggttgtggctgatctttggtgttctctggcttgtggatctctgcctccacagcaagctctatactaaggctgtactagaaagtgttagccttgtctctattgtatcctttgatatatatatacatatatatatagctcaaccttggctgcctccttgccagttggcctacgtggctgagaggcgttctgctgtccccgtccttgtgaaggtatatgcacagctatgtgtggacatagtgtggctgctctggctccggacagggccagcttcctcactgcttccagccccatctcacccagggcctctgcagccctgggagcagccaggctctcggcgcacatctctgagcctgcccaggaggattcgggcagtcacccgagcacctggtccctcacggaggcgcactctgcctgaatccctcctcccagatgacgagcgctcacacgaggcttcggtttcctcagtaaccaaggcctgcagctgactggtcacagaattccagggagaggtgtcccagggaccaccattgtgatgacatggcagctggccctcctcctgcccctgtccccccttattcctctagcgcacgcctagccagcccctggggggtggccagcccgcctcaggccaggccagctgagggagactgggaggcctgtggccagcctggccctggcagccacactctgtgctctctgagacggcgcacagccacctggagcatcatgaaaccatgaagggtgcccaggtgccaggagaagggagcagggctaggccggggctgggctgggaaggccggaggggcctccaacagaggtcagggtgcatttagagaaagggaatggcagaaacaagggactgacagcagcaacagggacccagcgggctccctggagcagaagtggggacaggtgggcaggtgagaggcagggggagaaaaggctcagtgccctcgggctctggggcacgccagtgcacgggagaaagggattccacagcaggcccatgggcctcacccaggaattcccagtcttttcaagacaggacaaggccacagaaagaacgaggccgcatggtacacaccaagatgagggtagggggaggacctgggtagggggaggacctgggcagggaagggactgcggggtgtgcctcgagtgccacctgcgggcatgggcctctctgggccccaatagcgtagccaggcagaaagccgccccagttcgccatgctccactcagaactcggtacccagtgcagtggctcgcacctgcaatcccagcgctttgggaggcccaggcaggaggatcacttgagcccaggagttccagaccagtctggacaacatagggagaccctgtctcaacaaaaaaaaaaaaaaaattgattagccaagtgggtggtgcgtgcctgttgtcccaactacttggagggctgaggtggaggatcgcttgagcctgggggttgaggctgcagtgaactgtgattgatccactgccctccagcctgggtgacagagtgagaccctgtctcaaaaaataaataaataaataaacaacccaccagaaatctgtgcccaggcccgatgccaggcaccctggagcacagaggcatctgcagtgcccatgccctcaccagctggccgatgccacgcgggagggaagcagggcacctgaggggcatgcccagcactgtggggccaacagggaggaggggaggacactgcaggcggggaacacggtgccaggacaccgagccaagaagcaacctgctgaggggggtaaggaccatgcccactgcaggccaaggggtgcctggagggagtggggcatcttgcaaaggctggagggcccctctcaggccaggacatgacacgaatgtggggttccgcatctctctgtcagtgcgccccacagcccatcagaggccgtgtccagctgctcctccaggccccaagcctctcatcgtcatctgtcatcagcggcatccccctcgcacaaccctgtgctcatggacagatgcccactctctccaccgagaaagcattgggagagcactgctgggctggggacaggacctcaaggggttgatttctgctctgcatgctcaccccctcccctcctcctttgggggacaccccaaccctgcccatctccatctcaggcaccccctcccacaattgtgctatagcccggcttcctccttcagtgaagggtggagggagcgcagggggccaggcagtggcccaggagccctgacccactccccacccactgccccatcctacctacagacacagccgcacagggccaccagagcagggatctcaggctctttaattccttccctcctggggtctacacacattgctacggccccatcccagagccaggccgggtgcaaagccctggagacagatgccgctcctccaaacgtcccgtctgctcctcagccaaggacagcagtggtccggggcaagcaggacacaggcattctgtgttgggtggtcctagcaaaggaaagaaaggactctcgtgccagcaccagcattgaggggaggctggaaagatgagtgccctgccaggcagatgtggggcagcgtgtacagcaggagggtgcaggcacataggcaaagatgtgggtgaatgtactttgcacatgtgatggacatgaagtgagggaacagagagaggactgcagcacgctaaacagtgcccccccaaaatatctgtccacctggagcctcagcatgtgaccttctttagaataaggcaagggaacacgcgatatcctgcttcgttctggcaactgcaaggcgcgagttggggctggaatgtgggcctggaggaagtcggggagaggactccggggaagcgagcaggagccagatggctcagggccgtggagctggactttgtccttgaggccacgaggggccactgaagggggctgagaggagaagtggccaggcatctgggcaaggacacttcctctggccttgatgtggaggatgggtgcgaggctggggccgtcgtccaagcgagaggggacagggcctgggtgaagagaaaatccagcaatgtgaggggtgattatggagagagaggaatcaagggcacccccgagtttggggtgtggaggg

SEQ ID NO: 2589 - DNA, 1900 bp, artificial
  synthetic oligo
tggaagcttcaggacagctgtgcttccaagggtggcccacgcggcgcccctgtcctggaggccacaagtctccatcagctgggactccttgcctggaaggtgactcgtggcacccacagctgtgattctgtctccagctgtgcccctgatcgctgcagggccttgggcaagtggcagcggtgggcaggagaggtgctgggtgctcccagatgccagagcagcaaggggctcagcagcctgagggtggggatgggtctgggtgcaggaagccaatggggcccaccaggctgggcctttcggtgctgggaggagatggggagtggtggagggaggcagccagacaagccaacaggtgctgtgaccgagcgcgcaggggcagaggcccccgaggagtgagatgagaaaaacccacagcctccaggagccgctctccacccccacagacatctgagccagggcaagcgctcgccacaagcccctgcctgggcctggccatggctgcctgtctcgtgtcttatcttgttacctgtggtgagacaccctgactggagaagcatgttcctggaagggggacggggtgggggatgctgaaatgcggccagaaaggcaggtgggcctttcctcctgggccaggcggggcaaaggttggggggatctgcagcaggggagccaggtggactgggaacatccttggcacccccaatctccccagacccatcgtttcacccttggtggctcccctctctcctggttcccttagccctggacgtccctgggccacgcgggaaagtcacctgctgccctctctcctcctcttcccctgcatggggtctggacagaggctccttgtctcccctcacttcccttcccctgtctagcccagggctgtgggtggctggctgtcccggtaaaaggattatatcatctgtaatgtatatccagacgcacatgcactgctgctcgggaggacaagacaaggagagggagccagtgcagctggccagaggggaattgtattgaacctgaacctgagccctccccaaatgggggtgctaatggctcaccaggtcccggcccgcagaaatcaatcgctgcacaggctggcgctctgtgctctacccccctcccttccctctcacctacctcctgtccctccctggtgctcacacccctgggcactcagctgcccggctggcctgcctttgacctcgtctgcaagtgacatttcagagccattttgtttcaaatgtctgggcagggctcctttgggagcggctgcagacaggtagggtgcttctgaagacatggtaactggtagcggggtacatctagaagatgccggctgaagcgcttcagatatgggagggtgcagagggaggagttggagggttggcgcaggggggtggggggattgtcatgtgaacagaaggcttcagctgcagaagccatctctgtgggacccaatggttacccagaaatgaagtctcggatgtgtgtgcaccctggctccggagcccgcagatgtgatccaggttccatgcagggacacaggcagggaggacccagcactcggaggcagcagcagcaggcgccgtggtgtgctgagacaagccaacagcagggcagcgtggggaccatgggcggggccctgaggagggcgcttggcttatggcaggaacgtgcctgcccctgtgccagctgtgaggctttgacggccatcacctttcccacggtctctccccaaaacctcatttgcctggagagtggcccggaatcgggccctgaacaaactgtcccttaacagatatggatgccttcagccaaagccctccatgtcagagggtgtgagttgggccggccgccagaggcactgctaggctaaagacctctctacccccag

SEQ ID NO: 2590 - DNA, 1200 bp, artificial
  synthetic oligo
gtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacg

SEQ ID NO: 2591 - DNA, 2000 bp, artificial
  synthetic oligo
cgccccctcggccagcagagagtccatgctgaaatggaagtcccggctctgcagggcgtccccttgcaggccaaacttgcgcaggcttcccggggtgttggtggagctcgggggttcgtcccccagcaggtcgtgctcagagctctcttcgttccgggtgctctcgtcagtccggcccaccccgctgtccagctcctggctgttgctcaggcctgggccggcatcgggagcccccttctcctcttcgtttccgggctagagcagaaaggtaagtaccgctcagttaggtcccacggacagggatgtcacgggatgtcacaggaggatcggaaggggcttcaggcctggttcatttccctgccaagcattgggagaccctgcacagcctcagcgccttccacccagttctctcctcctcgccctccccaccagcgcccttttccttcctcacctgctgggcagggggtgatttcagtttacgagcacgcagctccccctcattctcagagccaaagtcatccaggaagtcatcccggtcgctgtccttccaccttttcgccagctgtggagacaggccctggtgtccccacagcttcaaggacctccccatatacccttcttgtctgctctggaccccgcacttggcttgtttcggtgaagctcagcaacctgggggcagcgtcccagccccctcagccttcagaggccaggaggggaaacgggccctgagagacccctgcccacccgccctccatcaactccaggtcgttggcacatctgtgccctagtcacggccagcagcttccaagacagaaagcctgatgtcgtggccccgggtcgccctgccaggcatacacacctgactctcaggtcgggccaccagcagggagatgttggtgttctcttcctggctcaggatggccaccgcctcttcccggttctggacgtctacaccgttaatctgaggcaggcaggatacaatcaacaagcatgctagggctggccctggggcggaccctgggcgggtgcagggagcccaagcactctgggctcggctgggctaggctggggcttgagctctgggaggatgtaactaagtggaaggtaccagggagagggcggcctgactcttgcaagagcaaatgtgtgctcaggagagcatggagtggggcagagggagaggggccaggaggtttcagagcagcaggggccctggatgccagcagatcccataggcacacgggagccactggggtgagtgggcaggagagagatgagactcagcccgggtttaggacacggcaggctgctgggcctcagggttagctcttagtgggagagagctagggactggctaaagagaggtggctgggccgacgggcacagcggggccttgggccaggcctgcagcctgcaagtgctcacctggatgatgcggtctccctcacggatccggccgtctttggctgcaatgctgttgggatttacctgcaggacacacgcatcttggggacttggtgcctaacatgccctttcggtagaagggggcaggctcacctcaggggcccccaaagcaagctgaaggctctctggctccccttccagctctgagccccaggaagcagaggcagaggctgtggagtagtcacctctccccgcccctgccctgcactcctaggctcttctgcacggaagcctgtgcttttggtcagccccgggcattggtgggaagtaggacattgtccatctggaagggtggctttagtgggatgctactagtagggaggggagcgaggggccatccccctcctggggatacacaagacatctgcccaagatgggttcgggagaaggctagacagcaaccctgttgctagttctcaggcccatctgctgtcccacccaggcacaggcctctttctgcagatgactacctcactggacagtggctgaagccgtcgaccatcatcgcctcaccacgcagcaccctagctgtgatg

SEQ ID NO: 2592 - DNA, 1300 bp, artificial
  synthetic oligo
gggagatgccattattgcagatgaggaaaccatgtcagcaagctcagcaaggttgtggcactgagtcaaggtcatgagccaggacaggctgcccggtggccagaaggaggggtcagggaggaggaggccatcgcgggccagggcccaaggcggaagtaggacctaagcagctctgcgggatgctgtaggggtgaaggaaggacaatgaagggtagcagaaggaagcccattacgcacagcgcaggtggtggggcaagcagtgcccacaaggtcgaaggctgcttccgcagcaccctgggacagtatgctgcgaccttcaagtcctccttggggaagggaggcaagtagagaagggacgaatgactaaggaccaagaaggactgaacagactccaccagaattcagggcacgtgccatggggccagcaagggtcagcaggaagcacttctaggaggaggcagctcgaggcaggcgtgcagggtctcctcatgggctcagcggcttatggaagggctgttctgggcctggggaggctacacactagcattatgcccaaatggctatgccccgcaggtgagcgtggggacagaccttacccacagctaagggagcacacggctggccatgcacgcctcggtgggaggcggggaaggcttctggagcaggggacacctggcctccatcaggcaaagggaacagggccaagaaaagacccagggaggctggtttgcagttggaagcaaagcccccagtcagcacagagagggcagggcgaggagacccagagtccgcctagggatggagcaggctgggagcttgtgccagatgagagggcagaagggccctgggcatgggcgcaggtggctgcgcctgcacggagccctctgcttttccgagttgtgcgaatattagcaagtttagaagaactctctgtcctgcattctcacggcggcacctcccaccccgggtttctcacagagatgtcaattctgacggcaaaatcttgtcttagtgcccgcgatacagtagaaccaccgctgtacgagtcttttcgggaagacagctatctgaggagagcccagcttgtcctcggaacccctgtggcctcagcagcggctcctgcattactttttttctatttgactatgtccttgtagataatcattgaagttttctatgtctcccttctccccaaaattttcatattctgaaaagagctttttgtcaaaatcagttttgtccgattataaaagaaacacagttcatttttttgttttttgggggcttttttttgttgaga

SEQ ID NO: 2593 - DNA, 1800 bp, artificial
  synthetic oligo
caaggtgggaaaatatggggccatgagcaaagaggtatagggccaggcacatggtaaggagccacactgtggcccttctgatgacagcagctcttccagtcctgctcagagccttgcctccccgccccacccccaaccatcctgaggtagcacactggtaaagccacccctgtaatgccccaaccctcggattgcctactcgaccactccagtctctaaaaggcacaaacactcaacatggccaaccccaggcttgcttcccaccagactctccctcctgccccacctgcaaacgtttccacaccctgggagctcgccccaccaagacagaagacctagtccaagccctggccaagcaattccaattggatcaaagacctacagggacaaagcaaaacaagagaacaatatctttatggtgtgggatagagacgaaattctcaatatttcaaatggggaagcaataatggaagagatgtaaaacttctagacgacaaaagacaccctaaacacagtaaaaaggcgggctcagaggagagccttacaatgcatggacctcataatgggttttccagaatatgcaaagaattcctacaaaacaacaagaaaacacagacacaaacaactcaagaagaacatgggcaaaggatatcaacaggtgctcagggcaaaggggacccactagcaagcacttggagccatgagatgagaggagatgcccttcagaaccaccaccaggaggaccaggaggatgtgggcatgaaggccacagtggccaaacaccagggacagcccaaaggtctgccagcagtcgaacaaacaattcctggtattccgcatgtgcagttaatggaggcgcacataatggaggctcattcgtagtatgtacttggtggaaaacacggcagagaggcgagcagatgaagtgcgtaggggatgggtgggcacaggcggcttcaatctgcttttaataccttcttcaaggaaaaacgctcaggccaacaggacccacatcaaggctgggtggcagtgctggtgctaagtgatgcgagatgatgccccatacttctccagatgctacagcaagtccaggaggcctcaagatacccaggctggagctcagccttttatgtgtgattgtctaattacctccctttcattagacaacaaaccccaagagggcttcaccctgagttctacttccatcccaactcctaacagtttgctgaagataaaactttaatatgtttcttggctgaattaaaattttatatatttctgtaatttgttgaatatatattaaggacctgtaatttatctgatctaccttttaaaaaataataataataagagatggggtttcaccatgttgcccaggctagtctcgaactcctgggctcaagccatctgcttagtccccccaaaagtgttgagattacaggcatgacccagcccctgagtctgatgtacccggactctactaaaaatacaaaaattgcccagcacggaggctcacgcctgtaatcccagcactttgggaggccaaggcaggcagatcacctgaggtcaggagttcgagaccagcctggccaacacagtgaaaccccgtctcaactaaaaatacaaaacttagccgggcatggtggtgcacgcctgtaatctcagctacttgagaggctgaggcaggagaatcacttgaacctgggaggtggaggctgcagtgagctgagattgcaccactgcactccagcctgggcaacagagtcagactccatccaccccccaccccccccccaaaaa

SEQ ID NO: 2594 - DNA, 2450 bp, artificial
  synthetic oligo
gtttcaccatgctggccaggctggtctcgaactcctgacctcatgatccacccgcctcggcctcccaaagtgctgggattacaggcgtgagccaccgcacccagccaatttccacttcttaatgaccaactgaatggcccgagggcagcaactccctcctccacccagtgagatcccgggggacacaccatctgttttccttgtcacaatggccctcggacgcaagcactcttcactgccatttcacagttgaggaaactgagtcactgagccagtgggccatgcagcgacttgcccctggccacacagctgtcagttggtggctgcctccattcctatctccacactgcactgccttctctggcagggcccctgaagtagaaggaaggaaaggacacctttctccccaggatgcgtgcatgtggccatggagttcctgttctaaagctttggtgaggtctgttgctgggtggtaacctgcacatcttcagtgtgcaaagggcaggtgttcatatgtcatacatgaacctggggaaccatcaccaccgtcaggacagtggccatttctatcttccccaaaagtgtcctcatgcccctctgcccatccctgcaaccacgaatctgctctctggcactatcgaatttcatttcagcagactggacagtcctcaggaaccccgagatgagaggggaaagggcattctacaatcttgggacaatgacacaaaacaggatgacctggtccagaagatggcagtcagaattcagtgtccagccctctgttcttccactccacaaggactttctcagagcctgcttcttccccagtcagcttctgcggcagaaccactgagttgactgagagtccagctttcccctggaagggtggaggccagcgtggatgtgctggcagcatctggtgctggtgaggcggggaggcagagtgcccatgccagacccaaatccctgctcacaggaagcccccatgcaagcaggagggagccagagaagccacctggcttggtgggtgggagagcagtttggaggaagacgtcgctgaagaggggacactggctgccagccacgctcccgcactcaagcagtactttctctcccccgcagttgcctacatgttggcgatggtctcccccttacaaaaaggggagcctggggccaggcgtggtggctcactcctgtaatcccagcactttgggaggccggtgtgggtggatcacctgaggtcgggagttcaagaccagcctgaccaacatggagaaaccccatctctactaaaaatacaaaattagccaggcatggtggcgcatgcctgtaatcccagctactcgggaggctgaggcaggagaatcgcttgaaccctggaggcggaggttttggtgagcccagatcgtaccattgcactccagcctgggcaacaagagcgaaactctgtctcaaacaacaacaacaacaacaacaaaaggggagtctgggggaggggcaaggccctgtctgcagtgtctccctgctgaatgccacgcacccaggatggctgccagcaccatgggggctcacatgcaggtgctttaggcaagaatgcctgggagatcaccagaagggctggccagctgtcctttggcctccctcgatgtggacagaggggagatgacaggcggtcctgacccactccccctgtaaagcctgagtaggatgggcgggagaccagtcctaagtaccaggggtttatcccctgaccatctccggcgtgctcggatgctagcaagcacatcatggtgtcagagagggggtgccaaggccaagacaagttcagcagagtgtggaccacgatgagatatatgacaagggggcctggtggcagtggagggacatgggctgcagaaaaggctccggagctggggacatgctgtttcctgccttccattctgggcaaccagcctgcttccttttcctaactcaacacgcagtaatcctccattttcaggggaggtcccagattttccaaactaggaggacatgattggaatataggaatggggctgaggttccgacatgacacacgaaagtgcctgtgacaacccacatccgtggaataaaggaaccatgtggtcatctcactagccacagaagcagcactgcacaatccaatgcctctcatgataaaaacacactaggaatagaatgggaacttccttaccctgataaaggacagctatgaaaaagccacagctaactttataccccctagtgaaagactggaagcttctttacctttaagatgaggaacaagggaaagacattcacaggcacttctattcaacattgtactagagactccagccagagcaaattaacaagaaaaagaaatcgaagggccaggaacggtggtttacaccggtaatcccagcactttgggaggccgaggcgggcaggat

SEQ ID NO: 2595 - DNA, 4200 bp, artificial
  synthetic oligo
agaggctgggacctggtgatgcgtccacccccagaagcgcagtcccctgggacagctcatggcttgcactgctttccgtatctacttttttcagtcctcttgttttcccttagttgtgaaggatggttctcctcgtaaaatcccggctttgattgggccaaggaggaatgtagaaagtgaaagtttgcagccaaactcccacggtttcaaagggagcccagcaggaaagcgcacagagggcgcatgcggcagtggccctcctcctggcgggtctccttggggtgggcaagtcccttccatgaaggagagcttagggcgcagagcagggagggcccacccaagttcacctccctgaaggcaggcccagcccgacctgccgaggccttcccggagggctgtggggagccccaagggctaccggtgtcgtcccatggctcatttcaggcctggggtgcagctcgggtcgctctcccctatccacacgtccccacgaggttggccttaaatgaagtgcgacaccaatccttctccaggaaagtcaaaacggccccggaggaatcgcttggagaaatcgcttgccgtttgatggaatgactcccgaaaaggaagcaggaggatgggatccagagtccccgtcaaccaaccatcccagccctggaatccaacacggattccacaggacgccctctcggtcgcattcctatcccgctagggggctggcaatggccacacaaggtttccaaacagcgggaacaagagacgaggagtggcagccgggaactgagagggaagaaggcggaggacagcgaacgggagaagccgagggccccgcgcacccccggagaagggccggggagagaggaccaggagctccgccagggtggggcaagatttgcgtccccgccctgcccctcggctcccgcaccaggtggccagaggagctcggctcacagcgtgaagtcagtccccggattcctgggaattctcccccgtgcccagcccctccttcccccgcccccgcccccgccccggagttctcgccgatccctgcacgggttcccccacgttctcccaagccaacacccctcctgcaaagcacttgattccttcccagtccagaccaataaacccgggagttgaatccaggccactaaacgcatacctgtctgagccctgtctgctcctgggtgccttgaccttgacctccctccacttagccctaggaggtctcagcccacagcatccgggacatttctctagacagtctgcagggtgcacacagaaagtacacaaatgcggggccgggggagcctccgcgcacacagagacggggcacaggaacgcactcacgtagtcacgccacgcacaggcaagaagccccgttccgggccgcggggctgggctccaggtccgagctccgggccccgcgtctccttccctccccgcggggccctgctggtccacgccccgcaaagcccggccaggcactgccacccgcagagagcccaacccgctgatcccggcggcgcccactcacccgagacgcctaaggcccgggagcccatcgttcgggcagggccaggcgggagtgggtgtcggggtgggcacccagcccccggacggacttggaccgcgcccggggacgcccacgcactcccacgctccaggcccgccgggatctagattcggcgccccccgcacggcgggagcctggctccctcccccgccctgggtcctgcggggagagcgtgtgcggggaactgcgctcgttgctatgcaacctccatcccgcgcccgccgcaccgcgcctcccgggacggaagcgcgccccacccgggccaaccccaacttcccaccccacccgtggctggttcccacggagcgccaacacccaacagccccaggatgggagggtgcggacggctccctaccttgtcctcctcgagccctcccgctctcccacgcccgccgctccgggcctccccactggcccgctcctccccgcggagggccgcgcccccgccgcagcgccggcggccctacctgcagcatcactttgtactgctcctccggtttctggaccacgcacatattacatcccatgttgctggccggcgagaggaggcggagggcgggaacgggaagacgcctttcactgacccgggcgcgggacctcgggtcccgggccggggccaggggccataccctggcgcggggggcgggccgcctagcgggggaggggggcacgcccccgaggtgggggcagcggctcgcccctcaggttaactcttcgctggccgaggccaggcgcgggcatgctccctcgcacccggccaggagaaaaagggcagcgggggatgggcgggcgcgccgggcgttgccaggctacggccccccagggagcgcgggggcgcgccgggccgccaggggccgtcaggggccgtgggccgcgcgcctccccgcccgcggggcccgccgctgccgctgccgcctccggctcctgcccatggccgccagccccgggagcccggccctcgcgctcggcgccgcggcccggcccgcgacaggggggcagcggcgcggcggcggcccccgcccgcggccaggccagcgcccgcgctcccgcctcgcccggccgcgctctcggagctcccggcgcccgctcttcgtccagcagccgctggccgtctccagctcccgcccgggacgacgggcacgcgagcgcgcccacggcggcgggggaggggcgcgggcacggggcgcacgcgcgccgggaggggcggggaggggagcggggccggctgcgggagggagcggcgggggcgctggagccggcgcgggaagccgggggcgggcgctcgacggaagcgggcgggggtcctaggcaccccacgacacccggcgtccggtcctgaggggcgggcaccaggcgcgttgtctgcgcgatgccgctctgggagagaggggtcctgccaggaggagcagtctcctgggtcccccagagagagtccgcgatttcagcccctctccccggtcttggacgcagcagccctcacgcctctgctccttcctcgggcttcgccttaaatgactgcatccctccttcaactcagccattccctgctgtctttgaaacggacacctttgtttaaaacaagaaagaaagagagaaagggaggaaagaaaagaaagagagaaagaaaaaaggatgagcgaagcgtggggagggggtgggtcgtggggagagtggcctcggaggccttgggacccgggcctgcacacagcactggccagcctgggcccgccgcctacctgttcctcagccccagccctcacccggtccccgctttcacagcccttccatctcttcctcttctctcccaccacctccccgtcttcttggacaagcctggagggagaaggcctttgcctggaaagcagcagcgggtggaagtctgcgttcccagaggctgccccggctgcaggagatcacttggagaaattgctacatgcttcatttccaggtttgggcaagtgagggaacccccagccacacggggctgttgaatcggagcccttcctttcctccctggctcctcgttagaagagaaatcaagaatggcgggcctgcccagaatgtggagaagagaggcgagtttcttatccagggcttctcccagaaagcagaacttgagacaagggctggtgtgcaggttgcaacctgccacccaatggctggctagtcttgaggaatggcgtcatattgagggctcagcatcggtctctgcagctggtggatggaagaacattcactagcggcagtgtctagatgagccgtggtaagaggaagcccttgccgttgggcttatacagagcctccagccctcccaccatggccactggcatcgtgggtccatcgcatcctggggagaagctggctgacctccaccagatggtcccctctgttcgctagcttctggcgcgccccctccacactgcatgctccccagcggcatgggcgcgaagacgagcacggggccccacactctccctgagcactcccgtaggtacctcttcgccaaacctgtctcttcttccaatcttcctccacccgggtccctgaccagtcagcccagccattttccactgcccgggggtcatggacaccttcatctcaggccatttctccctctacaaagt

SEQ ID NO: 2596 - DNA, 8250 bp, artificial
  synthetic oligo
aggcgctggtaaagcaggagcatcaccaagcagaggacagcaaagggggtggcacgcccactccacaagccagcactgctccttctagggcacggatctcagagaaaggactgcatatgcccactttatccatgatggctaccattggaaacaacccacacgtccatcaacgggggaatgggtaagtgagtcgcggtgcatgcgtgcatacaatggctactagtcagcatcacagagggaagaagggacacagacgtcaacctggatgagtctcatggaagtgattccagaaagaagccggcacaaagggctccagagcgtgtgcttccatttccatacccgtcaggagcaggcgagaccatctacagccatagacggcaggacagggcttagatctgcagccagggattggctgcctggaggcacaaaagcattctctgtggtgatgcaaatgttctttagttggtccaagttgtggctgcatgtgtggataggcaggtgaaaaaaccaggcgtgcacttgattttctgcacagtaatcctcaataaggacttgtttcacggatttttagggcagtggagttactctgtatgatactgtaagggtggatccatgtcattatacctttgtccaaacccataaatggacaacaccagagtgaaccccgatgtcagctatgggctttagttcatgcgagcttctcactgtggctcaccaattgtaacaaacgtactacactgactcgaaatgttcatcatggggaggcgtaaggggagtgacggggtctgtgggaactccttactttccgctcaatttttctgcaaacctaaaattgctctaaaaagcaaaatgccttaattttttaaaaacccaggaaagcagcccagggccgatgtggcagctccaggtgctcaggccctcgggctgcctttgttgctgttccgccatcctcaacgtgcgacttccctttggtgcgacaaggtagctctccccatgatcacagatcacatttgcctttcagctgtaaggagacagaaagtggctggcacaaggccatgcgtggtggctcacgcctgtaatcccagcagtctcggatgccaaggcgggcagatcacctgagatcagtagttcgagaccagcctggccaacgtggcaaaaccctgtctctactaaaaatacaaaaataagctgggtgtggtggcgggcgcctgtggtcccagctactctggaggctgaggcaggagaatcacttgaacctgggaggcagagggtgccgtgagccaagatcatgccactgcactctagcctgggtgatcgagcgagactccatctcaaaaaagaaaaaaagaaagaaagaaagaaaggaaggaaggaaggaaggaaggaaggaaggaaggaagggaaggaaggaaggaagggaaggaaggaaggaagaaaggcgccagcacaggtttgccctgcaggtatgggtgcactcatgccccaccaccctactgggtgcatagaggctgggaaatgggtcttcagctgagctgccatgtccccaagccacaaatctagtgttatggaagaacagaaaaacagatattggagggcaataagtggacgctgttacaggtggggatcaagggggacaatgagtgtagaggagtcttgaggggttttgctgtaaacaggagcagtgaaacggggcaagagccagggggcatgcggaggcaggagcgggagcttccggtgatagaagctccaagggcatgttggtatgctgctgggcctgaccccacagggagagagaaaaattacaggtgcagaaaacaggaggagagagggggtctcaggggtggcagagaccactgcacatggtgggaagtgttcacctgagggggctagggctggggaggggacagatttgatgatgggaactcaaggaaagaaattctcgtcagatgctctcaacttgctcagtgaaacatgaaacaaagttctcaccttgaaagtgcagggcctgggggctgaggggaaggtgtgaggccttggagaaccagggaggaaactctagaattcccaaggaaggctggctctgcctgggtccacttgaggcttgtggtcataaatctaaggtgcttagtcctgggctgggtgtggtggctcacgcctgtaatgccagcactatcgggaggccgaggtgggagaattgcttgagcccaggagttcgaaaccagcctgagcaacatagggagactccatctctacaacaataatttaaagattagccaggcgtggtggcgtgctccagtggtcctagctacttgagaggctgaagccagaggatttcttgagcccgggaagtggagggctcacctgtgctgggttttctttctttctttctttctttctttctttctttctttctttctttctttctttctttcttttttctttctttctttctctttctttccttttctttctctccctccctcccttcctttctttctttcttgcttgctttcttgctttgtctttctctttctttcttctttctttctttctctttccctccctccctccctctctctctctgtctctctctctctttctttctttctctctttccctccctccctccctccctctctctctctctctctctctctctctctctctttctttctttctttctttttctttctttgtctcgctctgtcgcccaggctggagtgcactggtacaatctcaggtcgctgcaacctgatttttttacctgcctatccacacatgcaaccacgactcggaccaaactaaagaacatttgcatcaccacagagaatgcctttgtgcttccaggcaaccaatccccagctacagaggtaagccctgtcctgccatctatggctgtagatggtctcacctgctcctgatcacgccactgcacttcagcctgggagacagagtgagaccctgtctcaaaaaataaataaataaggtgctttgtactggtttagagggctgggtaccccagagagaacgatgccaccggggcacatcatgagtcttccactgagccatggagctgtgtcccttgagacaggggaagaggctcctgccgctggccacactctactctcatgtttgagcagtgaagggcccggccatggtgacagctaagcttggtctcaggaggccagcagaggcgaggatcctgagccccagcaacaatgtgacagcaacacccaaggcagccaacagccaggcctggcagggtgggtggaaggcccgggctctgggaaggggcagggaagcatcaggactgtgtggctgggccacacccgggcccgcctggcaggtcgctcctagcacctcccacagtgtgacgtggacaggggaagtaagtgttccgcgaaataacaaaaggtgctcttgattttcaggttttatttgcctgttataattctgatattatgtacatatatatatatacttttgtttttttgtagagggcttatcagtagaccaagcacaggcatacagggaggctgtggctgctgagcagtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggtgggggcgggaggaggctgaggaagacaactgttcagacgatagggagggcagggctgctaaggggtcctggggggtgggggcggctggaagaggccggccagtgggcagtgggaggaggtgtgcccgccccgcagccaggtagtgacggaggccacttggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatctcgtagtcagtgtcaggctgcaggtcccactgcgtgtaggagctctggttgtagctgacatactgtggcgaaagggaagccccacccttctcttctgccagggagagagggtggcagcaggggtgagtcggagtgccaggcaacccctctggcccagagcccccttccccaccacgccccaaggccccctttcacgcttacctcccaaggctttgaacaagatatggaacctgaagttgcactggccctccttggggacccaggagacgacactgtagttttcacccgctgtggctgagatgttgccaaaatctgagatccctggggggatgcaggggaacgaggagagtgtggcagctgccaggaagtctaaggccctccctcctggacccggctggccggggcctccctgttggcaggtcattcctccagcttaccagacaaggccatagtgcctccttcccgtacgatggcttcaccagggccctctttggtggtggcctgaagctggaagcggtaccgcaggtgggggctgagatcggtcaggttgtgtgtccgaagttcggggtcccgaaggttgaaggacagttgccccttgcccccctcatccactgtggggacagacaggggttggctgtggctgcagctctgccccctccccgtggcccctccacctcccttccctgctggggcggcgcacgcacgggggtggtaggagagcacgtagccggtgagcacgccgttgtggctgagtgggggctgccagcgcagcagcaggctggtgttcgactggcactccaggtgcaacgcctcggggtggccaggcactgcagggcacagaaccgagtggcaggtaggtcctcgcccaggtctggggaggagggcaggggatgaggcgtggggtgcaggactcacctccctctggggtgctgaaggtgaactcgctggcgggccccgatcctcgcccgttaaaggcctgcacctccaggtggtaggagctatagggccgcaagccactgaggatgacactggtggtgttggcgggcaccaccacatggtctttgtggatatgtctcttgctgtgcttcctctgactgccctccctccagtacgtcacctgcacaagcgaacaggagacctcgcaggggcagaaggcacccagcagggcccccagcgcacacccccaccacccttaatggggaccctcctctcaacccaagtcttccaggagagcggctggcaggtggcaaagccccctcaccatcctgtcgctttacctcagtgatcaccctcctgggcccccatgccttcaacccttacattgtatccgcggaggtggcccttgacctgggccaggtccaccggccgccacttgaccagcacggcacttgagttgaggatttcaatgccttccagctcagggattgcctgggggtctggaaaccaccagtgacttggatagagccataggctctcaccccagccctgaggccaggcccaagcccctacacacagagaagacgaattcggatattttatgaggtacagtttgaggaggagaggtgtgtttgcatggtctcaagatctcttcctggactgcttattagttgcaaaggtgaaaatagtagcttatacaaaggagaaaccatggctgggcgtgatggttcacacccgtattcccaacactttgggagacagaggcgagtggaacatttgaggtctggagttcgagaccaacctgatcaacatggtgcaaccgcatctctactaaatacgaaaattagttgggtgtggtggcgcgtgcctgtaatcccagctaatcaggaggctgaggcaggagaatcgcttgaacccgggaggcagaggttgcagtgagccaagaccgctccactgcactccagcctggatgacagagcaagactccatctcaaaaaaaaaaaaaaagaaagaaaagaaaagaaa

SEQ ID NO: 2597 - DNA, 1800 bp, artificial
  synthetic oligo
ccggcccagggctccctgagggtggggagggtcggtgcttgaaagggcccagggatgtgagccccggccttctggagtggaggcttccaccctaggacttacccaccaccaagagctgtgccctactctccaccacatccagttcggtactggccacgcagctgtagttgccctggtcgctgtagtccaggctgtggatgaccaggcgcccatcctctatgaagtacctgcggaggagccgtgtctgtctttcctgccatctgggctcttctcccctcccatccctccctcctgtctccttcccccgctcctgtcagagccttccccatcaaagcaaggacgaggccaagaggtctggacttccagcttttcccactctgccccctttcaccgtcactgtcctcacttgtcactgtccccaagctcctggaggtctcgaccgtccccacgccaggtgatgctgggctgcaaggaggggtcaaaggaggcctggcacgtgaaggtcaccctggaacctttcttctcgattgtgctgcggggcccctgagtgatctgagttgcatctgagggtaatgcgtgcgtggggaagtcactctgttgtcctccagaggcccagaccctccctcccagaggcactgccagccatgtggcaagggttgcctgacctttaaccttcaggttagccatgatggtaacattgttttggtcattggcagccaggcagaagtagcgtccggtgtcattggcctggaggtctcgaatgcccagggtcccattggcataggggaagaagcgttcgtcctgaagcactgttgtcccatcctcgtccagcctggagggagcagggcgggcctggctctgactggctggcctgggctccctgccctccctggctccctggccactgggacacgacactcaccactaccaggacgagacactcaccactgaacactgggcacaggcgctccgaaggccttgcacagaaggtaggcagtgctgccctggacagccatgtacgtctgattgtccgcagtcaggatcttggctggcagctctaggggaggaacagcctcaggagacagggcaggacttgggaccacagctgggccaggagccagggaccctctgcacggcttcctcgggcccccaagagccctgcaaatcttggttccctgctcccagctgaggcccccgccaggctgtgtctctctctgccttcagacactgccctctgcctcagatgcgcctctggtcacagccacccaacttttacgttattccaggcctaactgacagtcacctctccccagaagccttcctggcctagtccccagccttccctgaagttccaggagaggtgccacctgggctggccttggtcacatcctgtggcacagcggtccgctcagtcacagtgacaagacctttcccctcttacatctccctcggctatcgtgaggctgagtgagatggggcgaagggtgtcagcaaggagaaaggtcggcgccagcctggtaggccgaggacacatcagctgccagctgagccactctggtggcctggcccagtgggctgcagggacagactgggagttaggaggtaaggaagggagggcactcacggacaacgtagatgtaggcattggccagcaagagcccgtgccggttgcgggcctcacattgggtcaccattgtgtcactgggctgcacgttgctcaggatcagggcgccacgctgaatccggtacttctggtctttggccagctctgtgcatgcagcaggtgggcccatgggccac

SEQ ID NO: 2598 - DNA, 1350 bp, artificial
  synthetic oligo
ggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcc

SEQ ID NO: 2599 - DNA, 1500 bp, artificial
  synthetic oligo
acacaccaccacacctggctcacttctgatgaaaagaataaagcggaagcaatggctgcagctgtggggactaggtcacacaggcactgctgcttcctccttgttttctctctctctctctctctctctctctctcggattgctctgttgggtgaagccaggtgccacatcgtgaggacactcaacagccctatggaggagctcacatggagagaaacaaaggtcttccgccaacaaccatgagtgtgccattttgaaaaggatcctccagccccagccaagcctttgcatgactgcagtcatggccagaatcccactgcagcctcacaagagcctttgagctagaacaatccagctaagccactcctgaatcctgacccacagagattatgagataataaatggttactgtcattttgaactactgcatttgggggtgatttggtttgcagccacagatcactaatacatcttccctcctcctacacaatgcacggcctgggataacatactagccacatgaggtgggccctattatcatgtaggaatgaggaaggcagtgagctcagatatgtggacaggaacccaggcagagtcagccgtctgagctttgggaagcctggttttcagtagctctagggacttacccacacccccacactcccacccctgaactgctattatggtgctgtagcccccacggtgcctgtcactacccaccagctgctgtcccctctcctctgtgtccatcttttcttcatgtctttgcttctcctggcattctcctgctttgtgacaaatacccgtggctttttctgcacatgtcttttggcttctaatctcactgcagtttcaattccaagagagagaaacttatgggcccaaatactcattatcctcattttggtggagccttcatgccaggtaacttcgtaggcaactaaccagcctatggactagctagtcttggccaggtgcgggctcctggtccaggcagctgaggccaaggttggttcaagctgtgtgataggcagtatggccatctgttatggacttaatgtgtgtgtacccccaaaattcgcacgttgaagtcctaacccccagatggagcagataaagaagaacagagaggctggacatgatggctcatgcctataatcccagcactttgggagaccaaggtgggcagatcacctgagtccaggagtttgagactagcctgggccacatggtgaaaccccatctctacaaaaaatacaaaaaattagccaggcatagtgacacacgcctgtagtccgttactcgggaggctgaggtgggagaatcacttgagccttggtggggaggctgtagtgagccgagattgcaccactgcactccaacctgggtgacagagtaagaccctgcctcaaaagaaaagaaagaaagagagagaaggaaagaagaaagaaagaaagaaagaaagaaagaaagaaagaaagaaagagaaagaaggaaaga

SEQ ID NO: 2600 - DNA, 1000 bp, artificial
  synthetic oligo
cctgcccatacccagaaagaagacgcaaagtggggatcctgcccctattctctgctcccttcgggcgccttcttttcctttgcccctgtctgccagctgaaaacacccaggacgccaccgaccatacagccccctgggctctgacagacttgtccactccctccaagatggccagatgggattttcctcggcctgctttcccccatgcccaaattcagaagctgcccacctggggccaggaaaggccatggtagaagtagtatttcatctggtagttctcgggcaggcagaggaggttgcagtgctgcatgttcattaggtcctctggctgcagggaaggagggcagtggaacgcgctcagtctaaggcggcggtgaccacgggtgagaagcctgctccccgtcggtctgctcggccccgctccctcggggctgggcaggcactgtgacgatctgactttgcacaacgcccggagcacaggaacaggagtgggcgccccggaggtccccggagcccacccaacggaggcccgacatcacgcaaacaggagggaatcgcagccccggccccgcgccccggcctcttcggcgggctgggccagccccataggtccagcggccgcaggcacactcagggccaccgggccgggctcggccggggccctcgggagcatgcgcggcagccacccggcccggcgcccacgcggcgcggacagcctcccgccccgggcgctcaccctcgcattgcggatgttcataacggcggcggggctcgcgggtcccagcggatcgtgaaggcgcagtcagctgccgccgcgctccgaagcgacgccgggacggccggggctgggaccggagctgggctcgctgggcgacggcggaaggggcggtgcgcgccgggccggccaccggccggaagtgcacggccgccgggcccgtcctcccggccgcttggccaatgcgcgggacaggccagcgcacggggcgggccaatgcgcgga

SEQ ID NO: 2601 - DNA, 1350 bp, artificial
  synthetic oligo
ggacagagcttccgtttcatgcaatgaaaagagtttggagacggatggtggtgactggactatacacttacacacggtagcgatggtacactttgtattatgtatattttaccacgatctttttaaagtgtcaaaggcaaatggccaaatggttccttgtcctatagctgtagcagccatcggctgttagtgacaaagcccctgagtcaagatgacagcagcccccataactcctaatcggctctcccgcgtggagtcatttaggagtagtcgcattagagacaagtccaacatctaatcttccaccctggccagggccccagctggcagcgagggtgggagactccgggcagagcagagggcgctgacattggggcccggcctggcttgggtccctctggcctttccccaggggccctctttccttggggctttcttgggccgccactgctcccgctcctctccccccatcccaccccctcaccccctcgttcttcatatccttctctagtgctccctccactttcatccacccttctgcaagagtgtgggaccacaaatgagttttcacctggcctggggacacacgtgcccccacaggtgctgagtgactttctaggacagtaatctgctttaggctaaaatgggacttgatcttctgttagccctaatcatcaattagcagagccggtgaaggtgcagaacctaccgcctttccaggcctcctcccacctctgccacctccactctccttcctgggatgtgggggctggcacacgtgtggcccagggcattggtgggattgcactgagctgggtcattagcgtaatcctggacaagggcagacagggcgagcggagggccagctccggggctcaggcaaggctgggggcttcccccagacaccccactcctcctctgctggacccccacttcatagggcacttcgtgttctcaaagggcttccaaatagcatggtggccttggatgcccagggaagcctcagagttgcttatctccctctagacagaaggggaatctcggtcaagagggagaggtcgccctgttcaaggccacccagccagctcatggcggtaatgggacaaggctggccagccatcccaccctcagaagggacccggtggggcaggtgatctcagaggaggctcacttctgggtctcacattcttggatcctcggatcctctgactctggtggggacaggcagaccaagctctcttggacccgggaagagggacccttggaagtcacttgggattgagttctagagtcttgacactgtttcagcagatctatactttgaacccacctcaggcatctcatccacag

SEQ ID NO: 2602 - DNA, 3050 bp, artificial
  synthetic oligo
gggggcctgtggttggtgaagcccaaggcaaggctgtgaactcagggcaagggagacgtgagcaggcgctgccgtgggctgatgtgggcactgcatgtgcaccctggcggccaaaggacctacagctcatggggggcaagggggaggagggaagccaacagcaggatgtgcgcagtcagtctgccccccctacactggaggaggagccccccggcacaaatctcgcccgtttgggcccacggacatggctggcctcgcaaggaggatccggttccaggcctcggccctaaatagtctccctgggctttcaagagaaccacatgagaaaggaggattcgggctctgagcagtttcaccacccaccccccagtctgcaaatcctgacccgtgggtccacctgccccaaaggcggacgcaggacagtagaagggaacagagaacacataaacacagagagggccacagcggctcccacagtcaccgccaccttcctggcggggatgggtggggcgtctgagtttggttcccagcaaatccctctgagccgcccttgcgggctcgcctcaggagcaggggagcaagaggtgggaggaggaggtctaagtcccaggcccaattaagagatcaggtagtgtagggtttgggagcttttaaggtgaagaggcccgggctgatcccacaggccagtataaagcgccgtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaagaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggtaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagctt

SEQ ID NO: 2603 - DNA, 2950 bp, artificial
  synthetic oligo
gcattgtggttacttcagggatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggacgacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattcacctgttcttccatcaatgcttgccttgggagcaaaagagaaagtgagattccttcagtacctcatccagagctcatgccaacagcgagcggtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatg

SEQ ID NO: 2604 - DNA, 1500 bp, artificial
  synthetic oligo
ccctctgcctcccatcagcacacctaacatctcttcgatctgagtcatacatttctttttttttttttttttttttttttttgacacagggtcttgctctgtcacccagaatggagtgcagtggtgcaatcatgactcactgcagcctcaacctcccgggctcaagggatccccgctcccgctcagcctcctgagtagctgtgactacaggcacgcgccatcacgcccagctaattttttgatgtttttgtagataccgggtctcactatgttgcccaggctggtctcaaactcctgagctcaagcagtctgcccacctcaacctcccaaagtgctaggattacaggcgtgagcccccacgcccagcccatttctgctgtttcatgcattttcgtctgcctcctcactgtggctcccctgacacacacatccgaacctaactttcccacgggtcagggatctcctagaaactgggtatctcggctatggccactctcagtagagacatgccgagaccaaattaaaaagaaaccataatgataaaaaccacaacagccctcctgaaagcaaacggatttaactgtgataaacagcacaggacttgcagtatggattctcagtttgtgatgcaccagaggggacgcaacagtcacagggagcctggctggttgaaacacttctgtgtccagatcatgtaaaagttttgaagaagattttacggaagtatatgtttttaaaatgccatgaactcctgtgtcccctgcatctaacttagccacacagccagggtgtggtgaaatgctctcaggtccgcacttagcagccacgtagcctgcttgtgcctctgtgagactctgcttccccaaccataaagtaggcgtctgagggccaaagaacaaggctgcttaacctggtgccccagctcagttacgagcccgtgacaacagtgaaaaatcatcagcagccctttctcctcctgtagacctgcttgggccctgtagacctgcttttctgctcacgatgaacattagtaagggtaggctcgctgctgcagcaaacaaccagacatcccatgtcacagtccaatggggggtaccgggtcagaagtgcaggcttctagaatttgcagcaaaagtctgagagggggagagacagaggtattgccctgctccccggtagtcaccgctgtatcaagagggggcgaaagactcggatttgacaggggttaagagtttacctgagcacagcattctcattggcccctgtggcttggaaacatacggggaagtttgtaactgccaccaagttctgctgttgcttaatagaaagctgaccgggtaagtgtgattttcacaaaagggtctttgatgctcccaagattttagatttggttgccatgtcctatgaaaataatctgcaagagacgcctgtgactctgactagtcatctcattgacagtggttgccctgtaatattctttgattgtcctttaacagattc

SEQ ID NO: 2605 - DNA, 1850 bp, artificial
  synthetic oligo
ggcgagaatgtggcagaaggtgatgtcacataccctgcaagtgggaatctaaacagattcagggttttggtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatttgccactaagcccagctaattgttttttatttagtagaaacggggtttcaccatgttagtcaggctggtcgggaactcctgacctcaggagatctacccgccttggcctcccaaagtgctgggattacaggcgtgtgccactgtgcccagccacttttttttagacagagtcttggtctgttgcccaggctagagttcagtggcgccatctcagctcactgcaacctccgcctcccagattcaagcgattctcctgcctcgacctcccagtagctgggattacaggtttccagcaaatccctctgagccgcccccgggggctcgcctcaggagcaaggaagcaaggggtgggaggaggaggtctaagtcccaggcccaattaagagatcagatggtgtaggatttgggagcttttaaggtgaagaggcccgggctgatcccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaagacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgag

SEQ ID NO: 2606 - DNA, 1700 bp, artificial
  synthetic oligo
gcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgtccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaag

SEQ ID NO: 2607 - DNA, 2300 bp, artificial
  synthetic oligo
agatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggaccacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattca

SEQ ID NO: 2608 - DNA, 1600 bp, artificial
  synthetic oligo
aacccgggaggtggaggttgcagtgggccgagatcgtgccactgcactccagtctggcgacagagtgagactccatctcaaaagaaaaaaaagaaaaagaaaatcgagctactgcacggtgcggagaaagcattcaccagaaggcagtcatttttgaaataagtatctgagacccggcctgtgccccagctcagctaggagcacatgtgaagagaccagagctggcgaggcgactccggtcctgactcccaccttcccagccgactgggaccaaaggacgccacctccctaactagtgccaggtgtctaccggactcttgccacccccatgttgtcccctgccaccacagggtcagggccagccgctatgccgctgcaaccacccggcaggggctgccaagctggagcattttcgctagcaagggtcaaggcaggtgtgggactgcagggagagggctggctcgccccactgcagggcccagtcgctaaaagaagcatggacctgctcttccaactggcccctcaccctggctctccaggctcctgtcctggctccctttcaccctcccataggtggctcctgggagcggttcctcctctgcttccagtccccagagccaaggcctcacctacacttctcctcctgaagggactccagcaacagctgcaggtcagtcagagacctctcctttaggctgtgataggactcctggaggctgatgtggaacctcttggcttcttccagctctgcctttaccttctgcaacagcaggttttgttgctgggccacatcctctgtctctaagcacgtcccctgctgtaagctctggaagcgactctccaagatgaagggcctgctggcatgaggcaggttgaccggcccgtcttccccacctggctcggggggctctgaaagcagggccttctcactgggtggctcgcagttggctgggtcgctttctgccatcagcagtaagccctcgggcctgcagccttcctccagctcctggagctgctggtgacactggtggagcctgtgctcgatctgggcgatggtggcagaggcgcgctggttcaccttctcaaaggcctgctggatgtgcggcacctggtgccggtctgctttggataccagcttgaggtagctcacagtgttgccatcccgactggccttctccactctcagctgctctgagaggtagaggatgcggtgcctgacactatcctgtaagttgtgggctaggcctccatctgcgaggctggaagggccactggggccgtcttcgctggatgacagggaccggcatgaaggcacattggaggggagggttgcgctggggctcctggtgtgttccgcctacgttgggaaacaagaaatcacaatacggtgctctgtgagccgcaaagtgtgggagaattggacacgttatgactccataaaacacttccacatatgcatggatacttacacacgcaagatttgtgcattcaagatgggcccgacacagactgaggaggtgatgctcatcttcagggcccctctcccctccttttcagcgtctgactccttgctctacatgtgtgcctcactaagacccac

SEQ ID NO: 2609 - DNA, 4100 bp, artificial
  synthetic oligo
agaaagaaaaaaaagtatccagaatgcagcacagaggcacaaaaaaatagaaaacttgaaaaatagaagacatggaaggtagcatgagtaggtctaacaaaaatccaattgtcacaccagagagagaagacagacagaatgaagcagcagcaatatatacatatttttcttttttttttttaaattgaaatggagtcacactctgttgcctaggcggagtgccgtggcacaatctcggctcacggccgacctctgctgcccgggttcaagcacttctcgtgcctcagcctcccgagtagctgggactacaggcgcgtgccatcacagctagctaattcttttgtatttttagtagagatggggtttcatcatgttggcaagactgttctcgaactctcaacatcaggtgacccacccacctcggcctcccaaagtgctgggattacaggcatgagccactacgaccggccacagcagcaacattttaagagataactccctaagaactttccagaactgaagaaagacacaaattcacaaattcaagaagcccaataaatcctaagcagggaagacagaaataggtccacacctagacacgagattttttttttttttttttttttttgaaacagtgtttcgctcttgtcgcccaggctggagtacagtggcgtgatctcggctcactgcaacctctgcctcccgggttcaagcgattctcctgcgtcagcctcccaagtagctggtaatacaggcgcccgccaccatgcccagctaatttttgtatttttagtagagacagtgtttcaccatgttggccaggctggtctggaactcctgacctcaaatgatccgcccacctgggcctcccaaagtgctgggattacaagcatgagccaccgcccgcggccgacacaagatgttaaaagcagccagaggaaaaaaagctgattacctttaaaaccatgacttttagactgcaggctgccttctcaatagcatcaatgcaatccagaagatagttgactgatatcttcgatacactgagagaataactgtcagagagaaaaaaataggtcacattcaaagaatcagaagtcagaatggcttcagacttcagcaacagcatggggaactagaagacaatgaagtgctggccgggcacggtggctcacacctgtaatctcagcactctgggaagcccaggcaggcggatcacttgaagtcaagagtttgagaccaggctggccaacatgaggaaactctgtctctactaaaaatacaaaaattagccagcattgtggtgggcgcctgtaatcccagctactcgggaggctgaggcaagagaatcgcttgaacccaagaggttgcagtgagccgaggatcactcccctgtactccagcctgggcgacagagcaagactctgtcccaaaaaaaaaaaaaaaaaaaaaaaaaaagacaatgaagtgctgctttcgaaattctgagggaaaaatgatttcccagcctaaaattctacaccccaactgtcaactgtggggttagactaaagacatttttagacatgaaggagttcagtacaccactgacaaatgtaagaattcaacaactgtttaaaaagcaagtcttgccagggcagtggtgtgcacctgtggtcccagctactcaggatgctgaggcaggaggattacttgtgcccagcaagtagaggctgcagtgacctgtgactgtgctactgccctccaacctgggtgacagagtgagaccttgtctcaaaaaaaaaagagcggggggtgggggggccgggcgtggtggctcacagctgtaatcccagcactttgggaagccaaggcgggtggatcacttgaggtcaggagtttgagaccatcatggtcaacactgcgaaacactgtccctactaaaaatacaaaaattagccgggcatggtggcacacacctgtaatcccagctactggggaggctgaggcaggagaattgcttgagccggggagacggaggttgcagtgagccgagactgcgccactgcactccagcctgactgacaagagtgagattgtctcaaaaaaaaaaaaaaaagtaatcactagaaaagaagctacatatgtacataacatccaaataaccaagaggagaaaaaaatgggacttgattaatcaaaacaaaaacaaaaaagaaagaaagaaagggggagaaaaaaaaaaaaacaagggctgggtgtgctggctcatgcctgtaatcccagcactttggaagccaaggtgggtggatctcttgagcccaggaggtcaagaccagcctgggcaacatggcgaaaccccgtctctattaaaaaaaaattaatacaacaattatcctggagtggtggtgcacacctgtagtcccagctacccaggacgctgagacgggaggatcgcttgatcccggggatgtcgaggctgccgtgatcgcaccactgccctccagccagggtggcagactgagaccccatctcaaaaaataaataaataaaagcaaacaagaaaaaaaaaggcttgaaacatatctgatagataaagggctaatcaacacaatatataaagaactgcaaatcagtaaactaagagcaaataacccaatataaagacattaaagggtagccacggacatctcagacgacgaaaaacaaaagacagtaacgtataataaaacatgtaattgcaaggtgatccgggaatagtaagcgaaaagcaacaattaaatactattttctcatccaccagaacgccaaaaattaaaaagcctaacaatgtccagggctggcgagaatgtggcagaaggtgatgtcacataccctgcaagtgggaatctaaacagattcagggttttgtttttttttaatcgcaattaggtggcctgttaaattttttttcttgagacagagttttgctcttgttgcccaggctggagtgcaatggctcgatcttggctcaccgcaacctcgacctcccaggtacaagcgattctcctgtctcagcctcccaagtagctgggagtacaggtatttgccactaagcccagctaattgttttttatttagtagaaacggggtttcaccatgttagtcaggctggtcgggaactcctgacctcaggagatctacccgccttggcctcccaaagtgctgggattacaggcgtgtgccactgtgcccagccacttttttttagacagagtcttggtctgttgcccaggctagagttcagtggcgccatctcagctcactgcaacctccgcctcccagattcaagcgattctcctgcctcgacctcccagtagctgggattacaggtttccagcaaatccctctgagccgcccccgggggctcgcctcaggagcaaggaagcaaggggtgggaggaggaggtctaagtcccaggcccaattaagagatcagatggtgtaggatttgggagcttttaaggtgaagaggcccgggctgatcccactggccggtataaagcaccgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggc

SEQ ID NO: 2610 - DNA, 2750 bp, artificial
  synthetic oligo
cggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaagtcacagaggctttcactgcagtgtgggacgacctgagcctctgcgtgtgcaggcactgggtctcgagagggtgcaagggggataaagaggagagagcgcttcatagactttaagttttcccgagcctcatgtctaccgatggcgtgaaaggatcctggcaaaacagaagtgtgaggcaggtgggcgtctatatccatttcaccaggctggtggttacataatcggcaagcaagagctgtggaggggcttgctggatgccctcagcacccaggaggagggagggagctagcaagctaaggcaggtggccctcctggccccttaaggtccatctgctggaggcccagagtccttggagtacagtctacacctggaggggacccattcctgccagtctgtggcagggatggcgcgccacctctgccaggccaggaccccaagcccgatcagcatcagcatggtgcaggtgcacaggcgtgagctgatcagtgacgaggggcaggcacacaaggtggagacaaagaccaagaggacggttgccagtgagaggcgcggactcaggaacttgaacaacatctgcgggggacggctttggaggtgctccgctgcctccagttgggtgacttgctgtagcatctccagcttggatattcggctcttgaaggtctccgtgatctcctgcaggagacgaaaatgcacgcaccagaagtcagcacagagttgtggtcgtttattgagttcttaggggtgagcagaaagcactgtggagtgggtattcgaggagggaagcagagagcctagagcacattcagggcagaggggagggcgcaggctctccagcaacagggaaagcttcatctgacccggctgcactcccccatccactgtctcccgaagctgaggacctggtcaagacacagctacccagggacgggggtgggcgctatgggaatggaaaagtgaggagagggaagccaggtctaaggaggggttctgagagggcgctccctacacctgcagccgcagcagaagcagctccaccccagatctcccgagtcagaggctcacgggtgagcactgcagcaccagagtggcaaaagcagctaagccagatggtgggaagcggagcgtgagtgtaaagatcagatgctgctagctctgaaacaaatgtgtgtggccatcgaaccctcaggagggggcagctcgaggacccgtgtcttgctttggtttgggggtatcagaatagattcgctcatccctccagtcttcttgcaaggctcccccaggaggttctcacccatatttccttggctctctcataggatagataggccattctctcttcgctgcaggccagattgtgtttgaggttgtaaatctcattcagctgtccctgcaggcgaccattcacctgttcttccatcaatgcttgccttgggagcaaaagagaaagtgagattccttcagtacctcatccagagctcatgccaacagcgagcggtcctgacctagactagattcgggttcagcttctgccttcctccccgctccccaggctctagggaaagcctgcctcccactccaggtctgcctgggaacaccccaaacacacaccagccacacgcacaccaatattcatatatattttatatgtagttactcttttgtaacagctttacaaaaatagccacagactagaagttgtagaaatgacagtgtgaactatctgtgtgtgctcttcagttccgcaaatcccccaggaccagtgttgagcacgaagtctagcctgcagtttagcctgcagttactctatagaaacatggtgactataaggattgaaaagccacaaaagaccacagattccagtacaattccattagttacgaaatgtccagaataggcaaatccatagagacagaaagcagattagtgggtgccaggggctgggggtgggggatgggcagtggctgctaatgagtacagggttgctttggggctggtgaaaatattgtaggaccgggcacggtggctcacgcctgtaatcccagcactttgggaggccaaggcgggcggatcatgaggtcaggagatcgagaccatcctggctgacacggtgaaaccccgtctgtactaaaaatacaa

SEQ ID NO: 2611 - DNA, 2450 bp, artificial
  synthetic oligo
aaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttc

SEQ ID NO: 2612 - DNA, 1800 bp, artificial
  synthetic oligo
gcccaaattaagtggtcagagatctttggagtcatgaccagtgtgactgaggaattgttctagaatgtgcgggatagagatggaagcactggcctggggcttggagtcctcaggacctcctcctactcctgcccttgtaagtcactgagctggtttcctggcctgtaaaatgagcatgatgatggctctgcttatttcataagatttcaaaatttattttgtaaaaatagtttctatagggtgattgcagaaaatttagaaaatgcaaagaggcaaaaatgttttacctcacttatctcactacttcgaggtaatcacagcttctcacactccagacaattttactcatttaaggtatacaattcagtggttttcattctttttatggccacatactattctattgtatggagataacacattttattcttccattcagttgatgaatgtggattagttccacttttgtctcttgtgaatagcgttctgacaattcacatattttgtgaagatgtaggtttcacaaaatatgtgaaagattttgtgtagatgtagattttcccttcttatggacatgtatactaggagtggaattgaattgctgtgtcgtaggataattctgtgtaccctttcaagagtgtggtggggggtggtgtttaaataccgttttgtgaggagtagatgcagtgacactgaaggtggctgtaaagcattactttagaggaaggcattctaacagacaagccacgcttgcttgtattcaggtgcaaaatgtcaggtttggtgagaccacaggacacataagcgcacggtggcaacaaatggagcaacagattccatgattaaaatgtgcaatttctaaacacaggaaagagcccccaaagcctcacttcagtcccctagaaggttctaggcagaaacagtagggcagatcaaaggaatgagagcataggagccatgatcacccagcgaggggagtgagccctgttgccagcttggcctggctgtggcttctgagtaaacacgtgtgtttgttaactgttaagaacctggtaatgaatactccctggaagatgccatggaccctggcctctggccagtcccctcgcccttgagtcctcctaacatcttattgctctgattacttcccatggagaagccagccagcagggactcgggaaccatgtgtcccaaaacctggcttgaatccccaaatctgcttcttgactgtggggccttgggtagctgtagaaggggatgatggtgctgatgacggggacagcatgtatcccacaaagctgtggtcaggatgttagtgccatcttttcgaaacacccatgcaggcccaccctgcatacctggcagcttcctactccccagcacccccagcacgccctcggctggccagccccatcggcccctcagcacgatccttccccgccttgctgggattatgttggggctggcagcaaccaacccgcctgcccgcttctgggccaggcagccctgtgcaacccgagctgctcccctgtccccgctgtcccaccgccctccctggacgcctgctacccaccatcaaacaccgcctcgtgccggccccgcgcaccctcccgccccgtcggccccacgcttcaggcgctacctggagggcatggctcctacccgtgggcactcgccttcacccttggagcccggccttccccgggcagccgggagaggttctaccacttcacgaggcctcctcgccctgccaggccgaggtcagggttagagaagctgggtcgttagattcgggagagc

SEQ ID NO: 2613 - DNA, 1050 bp, artificial
  synthetic oligo
cccaacttcatgagtcacatttccctcctgtttttgtctgaaaatgggggtaacactggcaccgacatcctagggctgctgtgaggagggggtggatgctcccagccattgctgacaatgatgtgattggggatctttgaggattccaccccggaaccctgacaggtccagccttactctttgacctgcccactgactctactctccatgacggtggccagtgctgtcatcgtgaggctgtgggccccacttcagctttacctccaaaagtcctgtggcagaatcctggggtgacgtgtcccctctatggaaggtaggttgtctctgccaggatcccagcagtatgaccgcactaaggaggcaaggtgatctatcagccagggctcacagagacctgagccttttccccgtgcctgtgggcaggcaggccgtgctggagggtgctcagggcacctgctgggaggcaggcagattccttctcacctgctcacgcagacccaggctgacatggacctgctatccctgagctccctgtgctgaggcagcgctcacctcatctttcctttatcccggaagtaaccttgcaaaaacactgggttgagctgaggggttccgttcggcacactcacctgaaggcacaaggcctcctgacccagaggccatcaagaccaagtgcagcaagctgcttctgcacggccccagcgtcaggtcctgcttaggcctgtttttttttggttgtttctatttttttctctgtatttagagatggggtctcacctcgttgcccaggctggtctccagtgatcctcctgcctcagcctccaaaaattctgggattacaggtgtgatccaccgagtcccgacccctctgtgttttcatttgctctttgtttccacccagggacggccctcactcacctgtggcccaggtatgcttgaaatgacacaactacaagttgtatcattgctcctttccttgccttctcccaaactccactaaggatgcatggaggacaggcgatggggtctaacaggtgtgatgctcatccc

SEQ ID NO: 2614 - DNA, 1100 bp, artificial
  synthetic oligo
tgaggccctcagattttcctgcacacgcccttcccagaccctctgatgactgcaaatcccaccctacccttgacgggaaactctctgaggctgtccaggtcatcacccccagggaccaggtactggtgggggaatgttccatgaattaattgctgtactcagggctcttggacaagtctcccctgatcgcagggtcctgactctccctgtataagatggaggctctgctgctcaggagcctgcctggcttccagtggtctagagtggagctgcactgcaatggggctggacttaggctccaggtacccacagggtgggtgcagggggaccatcacagttcagcttcctggtgccatctgtggtgggacctgattgtggggcaaaggggtgggacataaaaggcagagtgtcgaggcaggtacagaacgggtggggggtgctccttagggagaaggcaaatctagaattccttgacctcataaggaaacagcttggatccgtatggggaggggtggcatgggggaggatggagcagcacttagtacacagaggcctctgggagaggggccaggattgcagaaggcttgcagaggtgctggggaatctgattttgtcaaaactaaaaaatccacaaggcagcctctgagcagcccagagtccaaactgccatctgtcccctcagctctgaaagatgaggtgcaaacccctgccctacccaaggctctcctgctgcacactgccaggcactgtcttcatggacccacacttccttccatattgctggggacacagtggggccttgccaacagtgattcctctttgttaggatctttgcgtgtagtcaaaacagggccccatctcctcattactcccccaggtgtctacctcttcccaccccatgggcaaacctccatggatgactggtctgtgaccctcaccagccaggccagccattctggacatgaccagagccctcccctcttcttcccttgtcaccagccctcaactgtgaaactacagatggcatgtcacctcttcatgctcccagtttggggcctacccagtgaggggcacactagttgattccatacaccctcagc

SEQ ID NO: 2615 - DNA, 2100 bp, artificial
  synthetic oligo
aacactgggctggacccagcggtcccatgggtgctggaaccagccctgcgggtgttcccaggcaccctcccgcgggaagaccggctggagggatggctcctgttggcacccacgtcgagggaagccaccgccttctctgcggggctcgcctttcctacctcccccaggagacagtcaggccaggaagcgccccagcccacgaccgcccgcagcagagcaggattccctccccggcggccgccgctgtcaagggacggggaagactttgttaccccaccgcgcgccaccgcggaatggtgcacagacacctccagacgccacttcccccaagacggccgcccgccccgctctgcccacctctccctggacgctgccgggtgggcgcggccctgcttccccacgaccccccagacgcgccccgaggcactttcgcagcacagtggagtgggaagggcggggcggcccctcgacggcgccgaggcgagagcggctcacggggcttcccgggccctgatctcaggcgacgcctgtccgcctcgtccccgggggaagacagtgaccaccggtctgcaaaggaaggggactcggcgcatgccccgcagggccggcccaggactcgcaggcgcggaaggcggtgccgaggcgggggcggggcgtggagggacagccctagtctccgcccgccggggcccacagctgcctcgctccccgcctccgcttcggtcgctcccggtaagctccaggcgcccacgggaagccccgcccagccccgcctatccgtcctcctcttcgcctgtcctcgccaatgaccatgctcagattgcacggaattcccgcccctcgcccttgactgacgctcctgctgcccagtggacgacaccccgtcgcgtgcgcgccgctgcggccctgccgggtgtggcgcggcgctctcaggctcctaggcgttcccggggcgagacccagggcgctggccgcagagtcgccggtgcacacgcaacagtgccgccttgtgttttgggtgtggacctgcgcttctctaagcgttccattcccgagaaggggcgagaaacgtccagaggtcgtggcacctgcccgccgctgccggggcgtcggccgtgggcgcaagtgaagcgccccgggagcgcggcgcgacgtccgtgccttccgagggcggcccgggtgtcgccgcggtgcgcgcgggagggcgcggccgtgggcatttccgcgcttgcgcgggttcctgtcccgccccggccccggccccggccccggccccggccccggccccggccccggccccggcccctccctctcgtggccccgcagtagacgcagcccctccctcccgcggtgcagcgcagccagggctctgctccgggagtcatggagtccatcaccgcggagcgttatctcagcggacccacgcggtgtcctccgctggggtgggccgagtaccctccgcctcccgcccgcgagatccatcccagcccctggcgggggcccgtggttcttcccgctcatggccacggaacggtccacgctcgcggagccgcaggctgagcttttgctggtgagggacaaggtcgtggtttcccgtggctggtggccctcacggaggagcctgctgggagcacgcccgtgtagggtttcctgtcatcgggttgccacgcccatcttgaacgctcgagtccacgcagaagtgtagaagtggatgtgtagctttatttgtaattctctttctttcttcctttctttccttctttctttccttttctttctttttgagtcagggtctcactctgcgcccagtctggagtgcagtggcgcgatgagggctcactacagccttgacctctccaccccagcgagggcttcaacctccagcctcagccttccgtgtagctgggactacaggcgcacgccaccaccatgtccggctaattttttactttttgtagagatggggtctcgctttttcgcccaggttggtctgggattcctgggctcaggtgatccaccccagcctcacaaagtgctgggattctgggcaccgcgcaccggccgccgcgcccggcttgatgtgtagtttcaatagaaacc

SEQ ID NO: 2616 - DNA, 1400 bp, artificial
  synthetic oligo
tggggtttcgctatgttgtccaggctgctctcgaactcctgggctcaagccatcctcccaccttggcctgccaaagtgctgggattacaggcgtgatgaactcaatttatttttctctttctaaaaaatacccatttgctttctctgtcccctgaaaagccttcaaagcaatgctaatgccattgcagctggcaccaagactatggactgaagtgctccctctggaggtaaatctgagacatgaccacagcgtttgtcaggaggacactgctgccaaccaatttgagttgccattggctacgaatggagcatcagaaggaataatggcccttcctgccggctgctctgctggtcttccttcctgcctctcttcctcggtcctgtccttctccccctcttcttccaaaagcccctgggattgggggcccactcaaggaaagcgtggagggcagctggggaccagtgtgaagcacgatcctccgctgagcgcagcagtgtcctgcacaaggaagttttgtggagtaaggaagggagtcggcgagggtgactgtgtcctggggaggggtcaggggtccaagagaggaacgtgtgccaagttgggtggtgacctgatgggctcagatggttgactggctttgcagtaaatatatgaatgatgtagggacctggctttctcaccgtttggaaaaggagttgcagatatgaaaagagagaaggcttgaatgtggattcgatttggagttgttggtgtgaattcattgatctagtttggatgtttgtccccacccacatctgatgttaacttgtaatccccagggctggaggtggggcctggtagggggtgtttgggtcatgggggtggatccctcatgaatggcttggtgctgtcttcgtgatagtgagttctcgagagatcttgtcattttaaagtgggtggcattccccccgccccgacacacacactctctctctctctctctctctctctctctcgcttgctcctgctttcgccatgagatacacaagctcttgctttgcctcccaccacaagtagaagcttcccgaggcctctctagaagctgggcagatgccagcactaggcgtcctgcagagcctgcagaaccaagagcccattaaacctcttttctgtataaattacccagtctcaggtatttctttatagcggtgcaagagtggcctgatacactgatggctttcaatatacagataggtatagaaataagcatagctgtaaaatagggctgtgtgtatgggtatttctcagctccatcacttagaaggcctgggaccatctcaatagcagtgagttgacttagtgcctgggtctcgatttctaaacaaccgtcttgattaaaaagaacagagctcactagagaaat

SEQ ID NO: 2617 - DNA, 1050 bp, artificial
  synthetic oligo
tcggtttctattggaatcttcttccctttccattcctccctcggggccctatgccgaggcaatcctggccggaaagctgcctgccgaaggcgccccaaggtctccctgagcaggcactctcagggcgctccatcgtcccctgcctgccggccaccgccactctagactgccaaccccgcgtccaccaccactgccctttccaggtacaccagtgcatgggccaatgccacctgggcctccaggccatctgtctcccacagtgtccttgggtttctgctgttggctggcttagttcaggaagtctcagcaactctggaacagtcccgcatgcttcccacttgcaaggcaagatccctcatagggcacctcccaaagcctgttccctgggtgctgagaacaatagggtttccacggcctgtgcctccattataagcagaagagctctgctttagcaactgtggctgacgtcagatgggtgcctgagaggaggaagggggaagagcaaggtggaggggctggaaaggcaccaccgtgcggtgttgggagcccctctgggggtggaggcagaggcagaagctactggagtgattcgagggagagtgtgtgattctaagctcagacagagctgtctgggggtcctgtttcctgttttgtggtttcccgtaagaagccgagctggccttccaaggattggaagcttctgaggcctggcagtggcattggcctgtgcactggtatacctggaaagggcagtggtggcagacgcggagttggcagcctagagtggctgcagctggcaggcaggggatgatggagcgtcctgaccggactgggcagcggtgacctccgtcctgctctactgagagggcgaccgtggtgcaggctggacgttgggctgcaccccagtcaggagtcattgggatgtggctacactcgcctggggtgacgatgggattaggtggaaggttaggtcagctgagtggtagcattctcgggttctctgactctgattccccatctcactccctgaagatgactcactcactttga

SEQ ID NO: 2618 - DNA, 3150 bp, artificial
  synthetic oligo
tgtgtctttcagtgttttcaaggtttagggcccaaaggaaacaaaacacacaccatgtctccgcagcatggtgcagagaaaagagtggacatgatttgacgtggcaaagctatagccaagggcacgagtccaaggaagacacacatgaacccagaaagcaggttcttgcctacccgcagggagggccggccagggacaatggaggggctgggggaggctgggctgggtcgcaggagggggctgggctctcgctggagggaacccctgtctggagggaggccggtcacccttccctctgccagtccttccaccctgggctcctgtgaccatagcgagaggagatgccagaggggaagcccaagctgggctgggctccgtcgggacaggggacctggggcaggagccagtggcgggggcagtagcaggaggtgggtcatccaaggaagaaggcttcctgacccagagctctaaggcgaggagtgggcacatggccctctggggacctgtccagctcaaagactccaggtgcccttcaggtaagtaaaacaaccaagtaatcctcagtgcaacgcgaaagtggctgggaagctggaatcacagtcaccacctatgctgagcaaaaccatgattaaaatgggttttctgctttcgctgaacccactttgtggatcagtggtcctagtagaaatggctcctgcagttgacagctccactggcactgaactctccttgattcttgctttgctgaatttcgagaatcttttaagattgctgggatagagggacgcacggggagaaatagcaggcgaaacaccaggtcctgccaagggaaggaggaaacaaacgcctccccgagggatgccagggaaacagaccagccaagggtgtggtcccacaccaggtgcttgagcccctgttgtcctgagaccattccctccctgactctctcctaactctgtccccgtcactcccactcggcgacctggctcgccctttgccctctgctcttctcactctatgcctgaccctgcactaactgtagaaaatgcagaaatgagaaacagacattcattcaacaagcatttattcttatttatttatttatttatttatttatttatttttatttcttgagagatggggtctggccctgtcgcccaggctgtagtgcagtggtacgaccatagctcactgcagcctccacctcccgggctcaagcgatcctcctgcctcaacctcctcagtagctgggaccacaggcgcatgccaccatgcccggctaacttaaaaaacatgtttttggtagagatggcggtctcactgtgttgtgcaggctggtctcgaactcatggcctcaagcaatccttctgccttagcctcccacagtgctgggattacaagcaaaggctctgaggcagaagtgtgcctggtgtgttccagaaagggctaggggccctgtgtggctgcatcagcgtgagcaagggcaagtgtgggaggtgagaaggccagagaggaaaggctcgatcatgtcgggactgtaggctgccatcagggctctggctttcactgtgagtgagggaagcccactggacagcttagagcagaggactggggccacctgacttgggtttaaaagccgccagctctagccatccagccatggggctagggtggccggctgcacctgggccatgtttgggcagaggtggcgggacggggtcacgggacaatgaaactaaagactcaagctctgggtgaatgaagcccgcacttgtggaccaggttggggagccctatctggaaagagctggtccctgtgcccgttctcctcctccctttcctcctgggactcccttgcaggctcactcctccctatttggattcttatgcacagaagactcattcgctgctttttctaccatcgcagcttttgagggcttttcagcaaggactcaatccctgtcttagtctgtttgcattgctatagaggaatacctgatgctgagaaattcataaagagttttatttggctcatagttctgcagctgtaagatgggtggtgccagcatctgcttctggtgagggcctcagaccacatctacttctggcaggaactggcggaaagctggcatcacatagtgagagaggaaggatgagtcattccacctggaatctggggtgaagtcaactccagcagaatcaaaactgctgaagggaaagggagggagtggttctaggggaaatatgcacactggtacaggggaacagaggttgggtgacaaaaccaacaggtgccctctgctgtggcacagacatttcaacacactcaaaatccacttccaatgttttgaaagaacaggactaggagagatggtttcttattcgagcagactcttcttttataaagtaaaggcgtgtatttccaaagtaatacatgcttgatgaaaatatttcaacatggaagtctgagatttaaaaggtgaaggttttatttccctaaagctattgtccagcgatgagcactcttgagcgtggaggtggctttccagggagttactgtgcacatccctacatgctcacgtggcgggagcacactgccaaaacaagagtgtgccatagcctatatgcagagatctggtgacttgttttaacctctttctatgctagtacccaactatctaccatgctctctctctagcttcctcacactttttcccctggggcagttgtgcagtgatttatttaatttttctgcggctgatgaacatttacattctaaaaactatttacgtggtggtgtcattaagatgctggtggattctacctaacttgcaaatccaggagtttctcagatggattcctcaaggtgggtggaagggtatgcaccctagaggaaaagagaaagttagccccagacaagcagaaggaggacctaataaatcacaaagcagacatcagtgaaacaagtcaaaggctagtaaagaatgctattggccgggcgcggtggctcacgcctgtaatcccagcactttgggaggctgaggcgggtggatcacgaggtcaggagatcgagaccatcctggctaacatggtgaaaccctgtctctactaaaaatacaaaaaaattggccgggcatggtggcaggagcc

SEQ ID NO: 2619 - DNA, 1400 bp, artificial
  synthetic oligo
acactggaggatgatgtggtagaggaggagcgttatacaggccagtggagtgagtggagccagcctgtgtgcttccaggctccccagagacaaggtgggcactgctgtggctgctgcacttccagcggagtctgggctgggcgtcttctcccctgttcacctcagccctgcaccctttcaccctcctgtaagcccctccccgaggcagccatgcctcagttgacccccttcctctgaaggtctgaggtctgtagggaggacagaaacacctgccaactctggggcttcctgggaacctgtagttagtggctgctgttaggagtgagggtggcagggctgcacaccagggctgggctcctgcctggaggctggacatgacctcagtgtccttaatgggggctggactgacccttgcgcactgcagtgctgagatggcccagggactttatgacccaccttgtggcagatgggaagagtgaggcccaggagtgtggttcacacaaggtccttcagcaggtgacacaaacctccaaggcccatcacaaggtccttcagcaggtgacacaaacctccaaggcccatcacaaaccttccactttggcccagggcactaaagggcgcacctttgccaggtgggtttggggggagcctcctggcactgaggctgctcacagccctgggcccttcctgtccacaggccctctgatcccaccctgggggtggccaggcaacacccttgttgctgtgtccatctttctcctgctgactggcccgacctacctcctgttcaagctgtcgcccaggtaggtggctgatgtgtgcgtgtgtgtacatgtgtgagcgggcaagagtgtgcatgttagtgtatgtgtgcagatgtgtgactgtgtgcatgtgtgagtgtgtggtgggtgggccatcaagggccgcccttgtctggttcctcccctcccctctccactgcctggtcctggacggggtgggcttttcgagtctccaccctggtccagaagagggttctcaagttgccaggggagagcagggaaggggggtctgaggcagaggctgaagataagggcagcttggtcccgaccagacccagagtcaccgagatcaagagccggaggtcctagtctcctgcctctggaggagcttggtttgttcatttgttcacatgttctacgaaaggacagttggggcatctggtgtgctcaggaccctgttctcagaacaagatggacaagggccctccttaaataaaccgtcacgcctcatgcaccacatgtcaggttacaagacagggtgcaggggccatgtcaggccgcagatgtgaggaagagggtgtggggagaggggtgttgggtggggctaagtgggagggtgcttcgcttctccttgga

SEQ ID NO: 2620 - DNA, 1450 bp, artificial
  synthetic oligo
agctgggcgccgtgggcaacaactgtatgtagtcccagctacttgggaggctgagggaggagaatcgcttgagcccaggaagcggaggttgcagtgagcagagattgcacacctgcactccatcctagtcaacagagtggggcttcctctcaaaaagaaagagggcagggcatggtggctcacacctgtaatcccagcactttgggaggccgaggcgggcagatcacgaggtcaggagattgagatcatcctggtcaacgtggtgaaaccccgtctctacaaaacatataaaaattagctggacatggtggcctgctcctgtagtgccagctttgggaggctgaggtaggagaatcgcttgaaccatggaggcagaggttgcagtcagcggagattgcgccactgcactccagcctgggtgacagagcgagacgccgtctccaaaaaaaaaaaaaaaaaaaaaaaaaacaaaaagcaaaaaacaaaatcaaaaacaaacatccagcactgatcccaggggcctgtttcctcggcctcaggctgatctcccgacagcgtctccgcgttcttcctcctctcccggtaccagggtctcttcccagaaagaaactcacatccgtaacctgcatcttggcctgaactgggggtgacccgcccaagcctccatgaaggggaatctcctacaaagtgaggtcctgctacaaagtgcacgacgggaaatgcagccgcgctcgctccgccacactcacaccgggggcgggaagccttttcctcaccttggcctcggccccaagtggtgtcccggagatgcagcagcgtctcccagtcctcaccgcggacgccgccccaggtgtccccaggtgtccccaggtgtctcgaagccgcggtctctcccatgcgggtcctggggagaggaagctcagtcctcatagtggccgcaaagtgactgccgctgtgtggatgagacgcggtgcgtgcacggcgccccgagttgccaggggccatgcgcccccttgcggcagccatggggagtctctgaaaatcagcgtctagatttttccaggctgtggattttggaaattacgactgaaatggagcccaccatcccatgccttgatcggaactcatggagcaaggaagcaaagaagatggccagttcatgcctgtaatcccagcattttgggaggctgaggcgggcggattacttcaggtccagagtttgagaccagcctggctaacatggtgaaaccgcatctatactaaaaatacaaaaattagctgggcatggcggcacgtgcctgtaatcccagctactcaggaggctgaggcaggaggattgctcgaacccaggaggcgcaggttgcagtgagccaagatcatgtcactgcactccaacctgggtgacagagccaaactccatctcaaaaaaaagatggccagtaggcaaaac

SEQ ID NO: 2621 - DNA, 1000 bp, artificial
  synthetic oligo
gcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagc

SEQ ID NO: 2622 - DNA, 1358 bp, artificial
  synthetic olig or genomic fragment
  misc_feature (1352)..(1352): n is a, c, g, or t
gctgcgttctgctcagtacagacctgggggtcaccgtaaaggtggagcagcattcccctaagcacagacgttggggccactgactggctttgggacaactcggggcgcatcaacggtgaataaaaatgtttcccggttgcagccatgaataatcaaggtgagagaccagttagagcggttcagtgcggaaaacgggaaagcaaaagcccctctgaatgctgcgcaccgagattctcccaaggcaaggggaggggctgcattgcagggtccacttgcagcgtcggaacgcaaatgcagcattcctaatgcacacatgatacccaaaatataacacccacattcctcatgtgcttagggtgagggtgagggttggggttggggttgcggttggggttggggttggggttggggttggggttagggtttgggtttagggttggggtaggggtaggggtggggttggggttggggttggggttggggttaggggttggggttggggttggggttggggttggggttagggttaagggttagggttaggggttaggggttagggttggggttggggttagggttagggtagggttagggttagggttaggggttaggggttagggtagggttagggtgagggtgagggtgagggtgagggtgagggtgagggttagggttagggttagggttagggttaggggttaggggttagggttagggttaggggttaggggttagggttagggttaggggttagggttagggttaggggttaggggttaggggttaggggttagggtagggtagggtagggtagggagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggtgagggttagggttagggttagggttagggttagggttagggttagggttagggttagggttagggttagggttagggttagggttagggttagggttagggttagggttagggttagggttaggggttaggggttaggggttaggggttaggggttaggggttagggttagggttagggttagggtgtggtgtgtgggtgtgtgtgggtgtggtgtgtgtgggtgtggtgtgtgggtgtgggtgtgggtgtgggtgtgtgggtgtggtgtgdnaartca

SEQ ID NO: 2623 - DNA, 1450 bp, artificial
  synthetic oligo
ctctcctccttctccgctccctgcactgccctccgctccctccggtcctcttctctcctctccccgttcgctccgggctgggccgtccggccgggcaagggggcgctttctgcaccgcggcagccgtcacgtggctcgccctggagcgcgcatcaacaggtccccgagaggagagcctgggcggaacgcgcatcaacaggtccccgagaggagagcctgggcggaacgcgcatcaacaggtccccgagaagagagcctggggacggcctcggggacccaggcgaaggcgctccccgcgagaagtgaggtcccccccctccacgacaacaccagagctggctgcaggctcggtgccgactccggcttgcccctccagagcacagggcacgccaggtgcagctgcgcctccacaaacacgcacggcagcccagacatcccggcagcccggcatcaaagcgcgccggcatctccgcccctccccaaacttcaggagtttctagaatacagctaagctgcagtgggcatccaggatctcgtcttctctgccactgctcactgtgataactgcgcttgtttgcaatcgtatttagaacaagaaaagaggggcggtggaaaagggggacgggcaactttaaatgagggtgagctgacattccgggggcctgcacctcgatcccaccgggaaggagacaggataccttcgggctgagggtcagaaactggccacatccctgccaggctgaacgctgtcagcagaaagcctcccgggtccccgatcaggaaggtcctgcgtgaccgcctgcatctgttacagtcaataaacctccttggacgggtcactatcaccccgagtcaacagcgtgcactgggctctcccgctgccgcacgctctgttgagtctggaaaaacgcaggatgacacggatctaccactgtggggtcacgcagaggagtttccctgccctgaaaaacgtctgtgtggcactgacgcacccaacccccgcaagccccgatctgtttcctgtctccatcgttttcctttttccgagtgtcctagacttggaaccagaagtctgcagccatctcagactggccttttcttctcctgcaaccttccacaccacctctgacgcccaccacagccccccacccgcaaggccccttccaactcttcttaggggtacgcccctctccacttccttctcttccacctccttcccttctccagccatcctcggatccctccatccttctcacttccttactgtccttgaggattcagaagtcggcctctgacccccggtaagtctccaaagggaagctttaagacagcaccagagggaatgtgctcaaaccaccaggagacgatttaaacaagtgcacccagtaacccacgatgcggggcgcaaactcacagggcagaggtgccgcccagtcacccacgatgcggg

SEQ ID NO: 2624 - DNA, 1250 bp, artificial
  synthetic oligo
tggataaaagtgtgggtgaatgcatggatggatggatgtattggtggatggatgggtggatgggtggatggatggatggatggatggataagtggataaaagtgtgggtgaatgcatggatagatggatgtattggtggatggatgggtggatggatggatggatggataagtggataaaagtgtgggtgaatgcatggatggatggatgtattggtagatggatgggtggatgggtggatggatggatggatgtattggtggatggatgggtggatgggtggatggatggatggatggatgatagatgggtggatgggaggatggatagataacagctgggtggatggtggatggatggatgagtgaatgaaaggttgggtggacggatggctgggtgggttgatgggtgggtgaatgtatgagtggatgaatcgtttgatagatgggtggatggatatattagtggatggatcaatgaataatagatggatggatagtggatggatgggtgattaatgggaaaagatagatgagatacattgatggatagattaaaaatgaatatatctaccaatcaatcaatcaatagatagacacacacacgcacacatacagttcctagttctggccaccgaaagctcatataagcagtggatattccgggagcaataagtatacttaatattcatgtatttacttataaatatgttttgtcccagctacttgagaagctgaggcaggagaattgcttgaacccggaaaaaaaaaaaaaaaaaaaagaaaagaagaaagaaacctccatgctcattgtttaagttttacaaaataaagagtgcctggttgcaaagcaaaccacaaaccaaaatacaacaagaagagggtgtttaaataattacctgctcctccttgccccaaagccatccagcctcccagcagaaagacggcagctccccacagcagaaccagccgccccatgcctgaaacaggagtggagagtgaggtcctcagggacctacaacgaacagatcactcatgactcataagcagaggtcaccatcgattttaaaaagtcagaaaggaaactagggaaatgattacaggcaggaagcacagtgacagttgattttcaaagatacacttgtcaagaacacacacacacacacacacacacacacacacaatcaatccaggatcaggactgccacgcacactgctgagctgagccctccccttccctccccctccccc

SEQ ID NO: 2625 - DNA, 1450 bp, artificial
  synthetic oligo
aatgacatccagggattctccacaaatgtggagggaatgaatgaatgataccccagattcacttctgcaaatgtagagagaatgaatgaatgatacccagatattcactgcaaatgtggggggaatgaatgaatgataccccagattcacttctgcaaatgtagagagaatgaatgaatgatacccagatattccccacaaatgtggggggaattaatgaatgacatccggggattccccacaaatgtgaagggaattaatgaatgacacacagagattcattcctgcaaatgtggagggaatgaaggaatgagtagcacacaggacttgcttgataaacgaatgggtgaatacataaatcaatgacgtgtagggttttctccctaaaagtggagtgaataaatgaaagagtgaatgcatgatgcccactagttcctgacaagtgtggagcaaatgagtaaatgagtgaatgaatgaatgccactctgagaatgcacagccaatgagtgacggaatgtgtggagcaaatgagtaaatgaatgaatgaatgaatgaatgccactctgagaatacagagcgaatgagtgatggaatgtgtggagcaaatgagtaaatgagtgaatgaatgaatgccactctgagaatgcacagccaatgagtgacggaatgtgtggagcaaatgagtaaatgaatgaatgaatgaatgaatgccactctgagaatgcagagcgaatgagtgatggaatgtgtggagcaaatgagtaaatgaatgaatgcatgaatgaatgcatgaatgaatgccactctgagaatgcagagtgaatgagtgatggaatggacagaaggcggcaggggcagtgtggacgttagccccaccgcctccctccggtccactttggtccagcttgctactggccctgacctctctgctgcatccatggaaactgtgcacccagcacccctcgcccctggggtcactccctgtctgggctgtgtggttctccaggactgccaatcaatgaggagaggggtgtggtccaagcctttcaatcactgaggataggggggtgtggtccaagcctgtcaatcactgaagatgggggtgtgtggccaaagcctgtcaatcacccaagagaggggtgtggcccaagcctggccagttagggggccaccctcaccctgttcataaaaattatctcaagcagtggtcatttgtttctgacatggctggtcggaacccttcaggaggtgtaacttgtgggtgccaggagagagagggtgtctcttttcccatttgattctgctctgaaaagatggggaccccaggctaccagagaccctctttccatccctatagagaaagtggtcttcctccagtgattccacaccctgcagctgagggaggcagaaaaaggtggggctgaaacgtgggaagagagaaagagaaaga

SEQ ID NO: 2626 - DNA, 1600 bp, artificial
  synthetic oligo
gatccccaatcatctccttggtacctaattatcttcctggtccccaatcacctctttggcccccaatcatctccttggcccccaatcatcaccctgctccccaatatcctctctgatttttcttttctttttttttttttttttttgagacagagtctcacactgtcgccaggctggactgcagcggtgcgatctgagctcactgcagcctccaactctctggttcaagggattctcctgccttagcctcctgagtagctgggattacagagctgggtttacaggcatgctccaccacgtccagctaatttttgtattttagtagagacggagtttcactatattggccaggatggtctccatctcctgacctcgtcatccgcccgccttggcctcccaaagtgctgggattacaggcatgagccaccgcgcccggcctttatcctctctgatttctaatattctctctgtccccaataatatctctggtccccaatattctctctgatccatcacccctctcttatggtccactgtaatccttatgctccactttaatccgtcccagtatggacaaaccctaagatcattgagtacccagcatggaacacggcttgcaaccactgtcaccctggcatcagcaggaaccttggcatcaaagtcacaggccggaggacactctgcatttgtctgcaggaagtcaattcacttggaccctgcctgcaggaatgtggaccgtcagtcatttgcatgagtgcttagaaacggcaaaggaaggtgtgtttacttagaagtgagttgcatggggtgaaggaagccagtcagccgcacctcagctgggtatttggtggtatttggtggaggtttcagaaactccccttcctttgcttccggtgagcgtgacggacaacctcctaattcctgtgcagcccgaaaagggtcccgcgaagagtgtttatagcccagaatgaggaagtgagacaaggggtattgcatggttattttttcttatgtctttctctttctctctcgctctctttttttttttttttttttttttttgagatggagttttgctcttgctgcccaggctggagtgcaatggtgcgatctcggctcaccgcaacctccgcctcccgggttcaggtgattctcctgcctcagcctcccgagtagctgggattacaggcatgcaccaccatgcccagctaattttttgtatttttagtagagacgggggtttcaccatgttagccaggctagtctcgaacccctgacctcaggtgatccacccgcctcaacctcccaaagtgctgggatgacaggcgtgagccaccatgccccgccctctttttctcgcttaaaaaaaaaaaggtgaggtttacataatgaaatcaatcattgtaaacggaatacctcagggggatttattgcattcatgcctccgtgcagccaatacctcgatgtagtttcagaatattttcctcacctcccacacacgtgtgtattgtaactttaaatgcaatcctcagatgacaaggctcggaatcgtcgtgcacgcacagagattcaacaaccaagatgcgataattatagtaca

SEQ ID NO: 2627 - DNA, 1350 bp, artificial
  synthetic oligo
gctccagtagcttttcctctgtgccgggaataatttgcaaagcgtcctattttggattttcataatcaagcttctaccccgtttcttttcagttaatttaatacctggagcacacgcagtacttcaaaaatattggtccgttctggtgtcagagagtctttttggactgagatgtaaaagtcctacatttgggtatgtgagctgggagttggggggccaggctgaggagaagcaacaaattccagagacaaacttggcatcttgggagatgtaatacacgcacccagccacagagtcccaggagaatgtattttaatggagaatgtggagggactttgcaaatgttttcattttctcaaatcatatctgttatcctgaaagtggtgtctgttccccctaacgcccccccgctccctccccaaccctttgcagacactggcatctgtggacatgagttaggtgctgcagtaccactcactgtgtcaactacagtattaactacggaaaacacacacacagtcacagtcacactgacactcacaccctaaccatcccaaatcagacatttgcagtcccacgggatttccaaagattccccggacaagcaatctatagattatcctgggaccagaaaaaaaaaagtcctaggatttttagtttccttaaccctcaagtggctggaaactgttaatcagagaggaatgaacataaataacaccaagccgagctccgtctgatccgaagtgagcccccaaacagcttctgtctgccctgattaccaaaggaagccatgcccacgcataaattggcagtctatttaaactgggtgttcttcctcacagttttttttttttcccagagaaatattcaaaggcaggcatttttctggctaagaagatatttatttaagtcacagattgcttcaccttcccaaacttgcccggcacacttggtgtagggcaaagcctcatccttgtcacatctgtccctctcccctctggagcaggggccagaggactttggaggacacctactccccccacccccaaggcttcggcttcccagggggggcttggcagtgtgagaaaggcaaaccgccttccgacctggttgaaattttgtttcccattgctccctagaggtgtcccttggccgtggataacgctcactctgttcctagcctcgcgctcaccgtgtttgtccatggaggttatagggaacttgagtgcggggtccccaccgccggagcagagggctagggacccgatagcgcctggtgtgccatagcgcattggacccacccgagagcccgcgttctgctgcaccggtggcggccacaggcgggagcgc

SEQ ID NO: 2628 - DNA, 1600 bp, artificial
  synthetic oligo
atgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagcta

SEQ ID NO: 2629 - DNA, 1800 bp, artificial
  synthetic oligo
cgggacactttgttctcgttgacagtctcaggtttcagttctggccatatgagtcttgggtggttcattattgtgaagactccacaaagtaagatgggtgtatggtgaagaataatcaaaggtaaataaaggcaccatctcgaagtggacttgccatgttgcatggaagcatgaatgtgttgagtcttttgttgttgaaaatggttctaggctgggcacagtggctcacgcctataatcccagcactctgggaggctgaatgtgttgagtcttctgttgttgaaaatggttctaggctgggcacaggggctcacgcctatgatcccagcactttgggaggccgaatgtgttgactcttttgttgttgaaaatggttctaggctgggcacagtggctcacgcctataatcccagcactttgggaggccaaggtgggtggatcacctaaggtcaggagttcgagaccagcctggccaacatggcaaaactgcatctctactaaaaatacaaaaattagctgggcattgtggtgggcgcctgtaatcccagctactgaggacgctgaggcagggagaatggcttgaacctgggaggcggaggttgggcagcagagcctcgggaggggaggaggggaggcgagagggggaggggagaggggaggagagttctagcatccccaagtctgcccttgagaatgtggtttgagaagggaggtggattctttcagtggtgttcacagagcaattgaaactttagatttctcagagtgagctagtttactaaagcctacatatctgaaaacataaacacttcttcattaagggtgccctttaagccagaaacaaactcaaccaccaaccaccaaacccacaaatgagacaaaaccaaaccaaaccaaaaatccaacaaataaacaaacaaaaaactttccctgagacaaaccacagaactttattttgggaaaagaaaacatttttttgttggtcaaactatcagctcctatgaaatactcttagagatgtttatcctgagctagttttttttgtggggaggtgctgtttacatgctatgttaaaaataacacgcaaaaattcacgagacattgatgatgatgatggttatacaaataacgagaataatgatattggcatacatcatgtgagtggaaaaaaaaagttgatggtggtgatgacaatacgatcgaaactgcttttgctccgtggaaagccctttgagatggggacctggctgtgcagtttgcggtgtatttgcctaaaacgccatctggctgctacgtagaggaagaacactgtttgcttttctggcctttgttttcataattcttcaatttctctttatgctcctaaaaattctacataatcccatttcgaacattgcattcattctctttttttttctcttagaaaacaataagggttttcattaagaagtaagtcataagactgcaagagaacaaataaaactcttaagaggtctccctccctccctctctctctgcaggctgggggtggaggattcaaacgaaattttgcttgagaaagtagcctgctcgcttcagaaaattgaatattttattcaaaaaaggttaattttgcagaaccaatttggcacacctttacatcattcacactaccttccctgccccgttatttagagaactctaagaaacataatctatacatgcacacaaagttgggaacagtagatactagggaatactagagggtggagagatggaggggccagggctgaaacactacctgtggggtgctatgctcag

SEQ ID NO: 2630 - DNA, 1800 bp, artificial
  synthetic oligo
ccttaaaacaaaaacagaatgctagaaaagaacaattcccagaagaagaaagaacatatgaggattaaaataaatcaggagaggagggccgacacaggcaatgtcagctacgacaccaagctgtctgggatgcggttcaagacagttgtggggggcaggtggtggacagacggctgctctttctcgttccttagaaatatgtccggtttggctgggcatggtggctcatgcctacaatctcagcactttgggaggccgaggtgggcggattacttgaggtcaggagttgcagaccagcctgaccaacatggtgaaatcccatctctactaaaaacacaaaaattagccaggcgtggaggcacatgcttgtaatcccagctactcgagaggctgaggcaggagaatcactggaactcaagagacggaggttgcagtcagccgagatcacaccactgcactcgacagagaaagactgtctcaacaacaacaacaacaaaaaaaaaaagaaggaaaaaaaaagaaatacgtcgtgatttttaaaacattgacaatattcaaatatacacagaaagaaactgcctgattgatattgctttatttcctgtgaggcagtttcacttcctgaggactacagagaaaccctgtcaccctccggcctccatcctcttcctaagactcagaatctgagctgttacctgcatctttgcgggtgaagacatagctcatgtgctttcacttcctggaaactttaccaggcttctcacacccttgtaacccgctgggattcaccacaacacctccagcagctggctgcagttattgcggttgtatgtatgtggttagaaacttccactcaagaatgagtcacaacctctgcactcccaagaccccatgcagacatccagtgaataaactgcttatttcctgccgtctgttttcctcatcctcgtactccatcctctctgttcttaggaatggaaggcagtggtgggggcaggaatcattccttttccttgcagtacatgtgtgcagcatggaatagaaagtgatttcagatacatagtgggaaggtgagctagttttcctttgactccatccatggcttatgaagcaagctgaatgctggctgtgggggtgtgaggatggcccctgcactacacaacaatgctcagagtttctcagggtttgtgtttccaattaggaggccacgcttggctggcacatgctgggccctcaataaatatctatgaccgatattgaatggacaattaaggcaaaggtcattaaaaataacatttggctatgtgaaaatcactcagattctagattttaagtgttctccccacaaaacatgatgagaaagtgagatgatgcatgtgttcattaccttgacgcagccactccacaatgtatacatacttcaaaacacgttgtgtgtgataactatatacgatttctatttgtcaattaaaaaataaataagttaaaaaaatagcatccggttatccgagttcatggtggggagccttctcatgaagcggttagcattctcctttacacaagacagacctgttactctctaataagatgctgcctcctggaaaatgtgtacccagagagcacacacggtccagcagacgtcgctgttgtggtatagcacatggaggcaggggataagattcgatgtgattgacaggcacatttatccaagagaaaactttcaagatctgatggagtaatgcagggtttccattcttatttcttgcctacttgaagttccttgagcgagctgaaagcact

SEQ ID NO: 2631 - DNA, 1050 bp, artificial
  synthetic oligo
gcagccgcgcatgcgcagtgtgcggagaggctgcacaacctccgtgcctgcatctctgagcatcccaggctggtgcattgtcccagagcaaagccaagctgctcaaggaggatgctgaaataatactaacagtcaacatgtcttgctggttgtgccttcttaggtatcatctgtcttttgggctgctctgagttttctttcttttttaacttttcaaatgccacctaaacagctttcttttttttttttcccgtttgccatcgtcaaaaaaatacttttttgtccctgtttctatttcgtgttcgtttatgtggtatattcacgtttaaggaaaaggattggaccttttgagaagcggaaataggagaatttcaagactttaaaaacgtgagggtgtgctgggcgcagtggcccacacctgtaatcccagtacttagggaggcagaagtgggagttgggggaatagtttgagcccagaagtttaagaactgcctgggcaatatagcgagaccctgttctccacaaaaggggaaaaagacaaaaaaaaaaaggtgtaaacatgagagtgtatttctagtttagtgcagacatagtggacaggggcatgcctggattcagcaagaattattatctatgatagacaaagtgcacctgtgtctgtttcctcctgggtaaaatggaggtgataaaggaggtgaggcaggccaagcccttagtaccagtgcataatatatagtcaataaaattatgtgttcttagaggtggtactataagagagcttcccccatttaatgcaatcgtgatttccctttgaggacacgggatttcagagaaggcaatttatgagcaaattaggtagggacttgcgcctcaaatacagtcgttcgtggtttctgtattagtttactacagctgccatagtaatataccacagactaagtaacctaaacagcagatgtgtattgtgtcacagatctggaggccagaagtcctagatcaagatgtcagcagtcttaattccttctgagggctgtgaggaaaggacctatt

SEQ ID NO: 2632 - DNA, 1300 bp, artificial
  synthetic oligo
cagagtggtgcaaataagctttctcagctccctgctagagagatattaaatttgcatttctcaggagaagaaactcattcagacggttggacccaagctgtttgatgagcacttaacaaagtgcctttgcttctttctgcgttttgtttgaagaagataacttctgttcagcagacctccattcttcacgcactgtcctgtaattctcaggaagcattttggatctagtgggagtccttcatggccaatcaaagcatggtgggagatcagaagcccgtggatccaaggtttctacttaagccaaaagaaaggtagtccggaggaacacaggaaagattgttgttgttgttgttgttgttctgtttttgttttgcagcatcttaacactgcagtgagaataattctctaattcaaccctatgatgtgcttacgtgagatttctctctggcagtgaatttttccttcatatgcacgttagtgattcattttcattcagtggcatgacttatcagaagaaatttcagtgtccatcaccctgggcatattcagaaaaattatttccctccaggtctccaaataagctgattttggaaataaatggaggacaaccttttgtgttacaaaaggcagcaacaaggacttacaaaaaagaagaatcgaatatctaaatgtattaattcattaacatgaaaattctttctgtgggtctcatctttgcaagcagatacaatattgccatagtatgagtatgaccatgccccttcctaacaaggtattaacatcagtaatagagaatggcaacaagccatagttggttacaccttttggaaaacatcaacattttaaccatagacccttcagctgggatgcaaggaaacagagtgctggcaacctcaagaatcaaattttagaggtgaaatatttagagcttgtggtccataattaaaacaaaatttgacttcattttttaaagttacaaaaacaaattaatgctttaatgcttaacacacttttgtctaatggagacaaggaatggatttagctgacttctcccagtaacttttgctgacttacagttgagccactagagaagaccttttcaatagagtgatacagatgaaaaagtcagtgagctgtatctgctttacattagttttgcagaactaaaggtgactctcttcatgggaacaatcccaagtttgtgtgtgtaaccacttatactgatcttgctttctgttcaactatggcagagggtttaatgtttacaaatggaaacatatttttctgaattgtgataata

SEQ ID NO: 2633 - DNA, 1000 bp, artificial
  synthetic oligo
tagtagagatggagttttgctatgtttgccaggctggtctctaatgcctgacctcaggtgatccgcccgccttggcctctcaaagtgctaggattacaggcctgagccaccatgcccagcctcgtgtcaaatcttagtagctcagtagaatagtaaggtaagatcaattcttcacatcaatacttaaatacttctcagattaaggactgtgtcttagaatttgagacctcaaaaataccttgtaataactatttctaaaagtccctaaattgtccaggttaagtgttgttttataaaaatatgtgtttgaaagaaaaaaaaagggatttctaatcttttaaaattttcatacagaagaaaaggtgaattcaaggtacatatgttatcaggttttttaaaaaattaaaaaataaaaataatttgtgtttgaggcaaaataatggattgagaaacagtaaaatgtcttaaagaatcatttacaaaattaagactaaattgagggagctttaatgattatggggaatcacataaaagttttcaaaatgtacatgaagctttggaaatgatgtttattgaattaaattgactataggaaaaggaaacctagagataacattctggaaatatgttctgcaatttctgtatttcataaatgaattaactctaaggcaattatgaggaagatgagataaatagtatttttcctctctttatctctttcatccttttttccttctctaagttatagcacctcaagcagagcctcttaaagacaaaggcttcccaaatgctgaaatacttataaagtctgatgggtttgtcttctgacgtttgggatttctttttattttgctttctatagaaaactcaacagtccaaaggccagaataggacgtcttctatcaaactctcaggttttcctgtcttccctcagtatcaaggcatagctttcactaacatttgcaaaagacatccatttaactaaggctgttgattaccc

SEQ ID NO: 2634 - DNA, 1200 bp, artificial
  synthetic oligo
aaatacttaaagtcaaatgtgggaggctattaaaaatataaacaataactattgtatttcaaaaatgtatgacaaaaatgttactggcttgcccctaaaatatttggagaagcataaacaaattaatagaagcatgaatttagtgaagtcttaaatgatataactttaattaaaaatgacatttctcactttcgagtggcctatttttcatgtgaagagcataatgttcttttcagtaaaatttgtacttaaaattttgtaaaatgagacttttttgaagcagtttttttaaacaaagctcaaataaatgatcatgtttattctgaatttcatgtttaaacatgaaaataaatctacaagtgctcttcagaattactgaaactctattctgttgaaagtattaagtgggtttttgttctctgatgttttcaagccttttgaaattgacattgagccacataaataccaagcgatttggagagaagccgctggaaattacaaaagcagctttttaacaggagacagcgccacacgctggccatttaaataaaacgggaaggaaagcacagaaccgtctctgtgagataacctaattttaggacaaagctgtccactctacagcatatatctgactggggtaatcatgccacattttcacttagcactaacttaattacttccagtgtggatttcaatattgcaaggcgttcctgcatctctacagtcacactgacctaaattagggagattagtatagcagtttcaaacaattttttcctaacttttaaacactttccaaatattccctacaaaattaactgacaaaggtggactgtgaattacatctatggaagcatctgtttggaaccactttttttgcagctcctacatggcttgctttttaagattttgtaaaatgtgagaacatatgaataaaatttgacgccagggaaaagaagggcaaaaaaagttgacaggctttatctgctgccttagagaacatgaagaagacccagaaactacctttcaacactcgccagccgctctgcacaagatgagacaacagccaagagatgaacataaacatgtttggaaacctgggggaagccctgcattgctccaagaccaagcgggcagggcctctgaatgtaactaaggcatgaactaactgtttcctcttctgtatccactggagctaat

SEQ ID NO: 2635 - DNA, 1550 bp, artificial
  synthetic oligo
ctcaaaattaattaattaattgattaattaaacggatgattaatgctgcaaaagaacaaagccatattttaatttgtagtgctaattaaaccaaagaagtttataccaatttccccaaccatgcaaagaaaaaagaaatatgaaggaactgtctcatgggaataggcaaaaaggtggcatgctctcacttaatgtcattcaaaattgcaaaataaaaacaaataaagaaactgcaatttaggaggtgcattcacaaattatatatatatcacgtgtgtgtgtgtatgtatatatatgtgtgtgtgtgtgtgtgtctgtgtatgtatctctctttttccaagaaatctgatgtgctcccttagaagacgtcaaccatcctccattccaggatgagaaataccttcataatcttgtcataaatcaatcattttccagattttgtccagttaaatgttttgtttttcattttcttaagagttttcacatatcttataagcatggcctttgtgttcctgtcttgtgctaagcatgtatcacaaattgcatctgactgtgcatcttctagctttcttagcaagaagtgcatttaatcctgtgctttttaggaaaatggacacctcattccttttcagagttaaataaattgtatgctctaagctgcatcaagagtatatctatcttctaggtgaaaagatgccctggctgtgaggaattatctaaggcttctggaatttcaaaaggtgaactctttattgccccattttatgcaagatcccttctctacttccttcaaaaaagtactattcattcatggaacattattgcattgggctaagactttggcataattataaacagtactttctcagcaaactttgagcagaaatacgaacaattggctgttggtgacaaaatctcttgggctattcttacttaacctgagtttcagaggtcggggatagtatagatacagaggcaagacaggggcaacaatattctggagtaagagagaaacttctgtcaccttcaacctctccctctatttcacaccatcaatcataggttacaaggtccactcaattctatttctactgtgtttatccatgcaatttgtccccaaaattattgccagactctatataaatacaagttgtgtcttgcctgaattatgtccataatctctctttggcttgctaaatctgggctcttctcacttagtatataatggcttcccactacataaaactaaaagcacagcctcaagaacatttaaactcagatcatatcctttcatttcatttaatgtagagccaccccattttcaaatcttgggtttaagctatgacagacacttcattgttacctgatgaagccattcacactcaggtttccatgcatttgctctgtggaaagctgcctcctttcctcccttctctcactgatgaacttacatccacccttcaaactcagttctaatttggcatcatggaccacctcaagccccaaggtagaattcatggctttctcttctctatttctgtttgtaattt

SEQ ID NO: 2636 - DNA, 1600 bp, artificial
  synthetic oligo
gcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaaagattcttggcgactagaagcgtttgaagataatttactggttttctcggctttcctgcctctccacagcaggaagaaattaagtgattcctaacccgccgcactggtaatcagtttgggaagtgggatggctttgttgttcaaatagcaaatgagacaccagcgtcttccattctatattttctgtcgcttttatgattacaaaactttgtggagggatttggagaagccttgtttagctttgcactaaatttttgttgaactcaggaaagaggttgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcag

SEQ ID NO: 2637 - DNA, 4700 bp, artificial
  synthetic oligo
aattcaggatcttcaagtaatgaaatctgcattaaaaaattagccaaaactgtttgtttattccataatcatgtctatatggtgcttttaagaaaacaatttttttgttgctataaaagcaatacatattcactgtggaaaaattagacgatatctctaagcttaaaagaagaaaaatttaaaacacccttaatcccactaaccagtgagataccatgtttgatactttagtgaattcatttcctaatagttttctgtgttcgcaaaggtatatgtgtagatataaatatattacacctacatagaaacgacggatcactcagcacataatgctttgaagcttccattttttttcccatttaatccgctgcacatgtctttttccatccgtgtgtaccaccgtattagttttaattcttccactgcacagatggcttataatttaaaacatcccctgtttttggagatttaacttgtttccagtgctttgagatcataagtaatattgcagcaaactttccctagtcaggggtttgcacaccgttcttccccccacccccactccccacaccccaggacaaattcttggacatcaagttgctggagcacatgataccaacagctgtagggcccggagtaattggcgaaactgtgtatctgtaaggcatttggtaggaaaaatgctaaacagaccaccagaaagattgctcaacttacattcccatgggtggtattggtttttgctttttttggttttgttttttaatcttggctaaaatgacaatttgaaaggcgagggtggagggtgttcagacagctctctcattctgttgagaattgcttggcccagttctgggccttgtctgaattgccggtttgctgcaatgttttttacaattgagcaatcacctagaaaaaagagaaggtgaaactaacctactgcaaaaaaactgctccaggatgaagaaggttgcctgtatttcgtcatttcagccaagccggaatacggagcaaggctgtctgcaccgtgctaccatcctcttcaggctgcagggcattttgtatacccaccacctcccattgatgctggaaaatccggtcacagaattccgtgcagcccagcccctgagggtggggcgtcctgtctccgggacgccgggttttctctggacacgaatgctccgggggtaggaggcgaatgacactggcacggcggggctccggagccaagaggtgaccaggctggctgggcagggctgagtggctgggccgagcacgtgatgctcccagccggcctccggggccctccgggctgaaatcgacatttgcctctggcaggaaaatgagcttgtcagtttctgcctccattagaccctcaacccaaaggagcaggagatttcggtagcgttttaactttatctcagaatctgaaagcggaaggtaagctgcttatcactcagaaaaacaaatttgagaggagtgacctagtaaagtacactgcgactttgttgatttttaaaatctggtgttgaaaataattgatcgctgtgagagtcaagggctgtatttatccccaaattagagattaaccttctgaacagaaatttggttaatttggagggaatcacggtataagggccagggttaaatatagaaggacacgaaagctgatggaataaactgcaagtaaacttaactctagcctgcttgtaaaacaatctatttcatgtctccttcagggctgtgagcaaagggaatgttaaaattgtgatttttaactcaagtgaaagtaaatgaatctatttgcaattggaatacaaataaaagcagtctttgcttttgtccttttacatttcaaaaacgcttgtgtattttggcaaaagaaaagtttatatgtgcactgcttaagtttgaaatacgctatttcaaatttacaaaattatcacagttgtaattttctaaagtctttctaggcaaggctgtttcagttgtgaatgagaaatgttgacattgtacatattttctgtgatagtaaaatgactcacttcttcagaatgtgataaagattagaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcagctattcagagtaattaaagcattattcatccgtgcaattagtataatgttccataatgaattgctttgaactaaagtgtttggtataatactcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgt

SEQ ID NO: 2638 - DNA, 2400 bp, artificial
  synthetic oligo
cagtccctaccaaggcaagggcaattcattgcaagcagacggcacttgctcctccgcaagtgtttttctgcactcactgaaacttgccaagcctgcttgctgagcgaacaagcgagggggcaagaaggcggagggtttgcgctgaccattcgaagggggctctgcttcatctcccaaggctgtgggaaagggacagaaagttcgaaacccctcccctgcgctcttaaatggaaagctcacttcccccaaagtgtgcagggtggcgagcacccaacccacttagaagaaaaagtgaagagcttttccggttgcgatacagatgctaactttcccatccagatttattcagagctggtaaaagcaatagcattcctcttgaaatccctgcccttccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatctaacagctctagttctgctaaaagcttaactagctaagggccttaaatccttgcattttaagagctccctaacagcattaaaacatttggaaggtgcaaaattatttcagccagaaaagttcaacactcaggacccaagggtatttttaaaaggatatcttgcactgaagccctacttttgcaaaagactggaaaggaaaccaaattgttatgagtaacaccttaactaaaacgaacaatccagaaaggagggtgttacctacctcatctgcatatagattaactgtatattcaatttaagaaaaataaatcttaatgggaacgtgcacacaatttttttgaaatgcagcaaatgaacaagaatctttacctactgaaggcccgaggcataatttcaaataacactattgtcatagaacaatacacactgacattttgttcagaaaaaaaaaaatttagtgcatccacctttctctatggtttggcttccctacagggttgatctgttgaacttattaacagggacaagctggacatcaccttggcaggattgcaggagagctggagaagtagttggcttcttagaaacaaactcagaccaaaaaaaatttccaaagtttgctttcttaactccata

SEQ ID NO: 2639 - DNA, 1400 bp, artificial
  synthetic oligo
ccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagttta

SEQ ID NO: 2640 - DNA, 1300 bp, artificial
  synthetic oligo
ttatttttgacccaactaactcccatttcttttaaaattataggaaactaatattttccaaatataaaaacaaactaaaaacaaaaagacacagacacatcaaagcacagataaaagggggaaaaaatcatccaacatcatgatgccatagctcgtcaccataactattttggagtttttccttctagtctcttttttaaaaaaaaattaagttttttaatagtaaagaaacacaataacataaaattaaccattgcaatcattttttaagtgtacagttcagtagtgttaagtacattcacattgtcgtgcaacagatctctagaactttttcatctaccaaaattgaaactctgaacctattaaacaagtcctcacttcccttttcccccagcctctggcaaccaccattgtattttcatctctattaatttgatgactccaggtacctcatataaggggaatcatacagtatttttctttctgtgactgccttatttcacttagcataatgtcctgaaggtttatgttgttgtagcatgtgtcagaatttctttttattaaagctgaataataatccattgtatggatagaccacattttgtttctgttggtagacactagggttgcatccacctcttggctattgtgaattatgctgctgtgaacatgggtgtgcaaatatctctttgagatcttgctttcaattcttttggatatagaagtaaaagtgggattgctggataatatggcaattctgttttcattttttgagaaacatccatgccgtttctggtaggcactgtaccattttgtctcctttatgaggcacaagtgtttcagtggttagttcaactcatcattttctttaaataaaatttaaataaatgttgcctaactgaacccccttttctatgccccatggaaaatgcaatcccctgctcgaaatgtctgtcttgaagacttttattgtcatgtttgcatcaatttcttctcttattgttttcctctattttctcttttttctgggagtatttctcaatttttattcttatattactagtcaattgtaaatcacctgccaccagctaacttaaatttaacaatgttttttatttccttgaagtctctttctcctgacctgcttgctttttagtaagacaaatagattgagaaaagaaatgctttcttaaaaaatgagattctgaaaaccctgaccacttagctcgtggattaaaaaaaatctttttctcagcatttagatgagattttgtatcttattgctgttgccagataactt

SEQ ID NO: 2641 - DNA, 1200 bp, artificial
  synthetic oligo
aaaaaaggagcaattcttgatgaagctttgttatccccaatccaatgcagccaggttaacttaatttgagaagctgatcataatgggtaactattttcaattagggcagtaccctaatatcagaaatctttatctgctcagcaggcaagaaaatcaatgattaaattttccaccctatttctgctggtaggtggatgttcctctctagatttcttgatgctttatttatccttgaactttctttctgttgccttgaattttatatgtctcatacaaacagcataaagttggaattttaaaaattttaatctgactttatcttataacttcagcttttattttactattttgtaatgatggatattcacatgcatagatttaaatctaccatcttcttttgtgctttgtgtttctttcaatgattccatgttccttgtctatttttttggttgttgtcttatattttttggcggggcagggggaaagggcgcagaggaaagctgggcttgccaaggcagggacttttctgcttccatctatcttgtgcatctactgccaatgatgactgggtatgggtgtgacacatttccagggctatctgacttggcaggtttctctccctttagtggttaccataaaaaatcaaacatgaattgttagctatcaaaatctaaagttaatcaatatttttatccttctcccatggaataagaaaaatatttaaactccataaaattactgtatatgctgttattgttatcgtgtattttaatttgtctcacaagataagatgaattttgcttgatacggtcagtgttggtttggagttacccaaatatattttgtattttctttgaacttcttttcttcatgcatcttaagaatttcttctggcatctttcttctttttttttaacctggtttatatatatgctttagaatttcatttcaagtgcctctgttggtggtcaactatttctattttaatttgccttaaaaatgtatttattttgctttttattcttaaaaggtatttttgttgattatattattctaggttggcaattattttctcttagctcattaagggtataattccactgtcttgtaacttccgttgttgctgagaagtccgctttaagtctcataattcttttcaagataatatcttttttactctgggtactttaaaaatatata

SEQ ID NO: 2642 - DNA, 1100 bp, artificial
  synthetic oligo
catgtcaacccaaaacataccttgaataccatctgcttgcaaatgtaaaatactatcttaggataccttgaggtatctgtagggtttggggttctataatccaaccaccatttacagcaagctaaatgagaatgctatataaccttgggttagtctgaaaataatctttgtgagtccacaaagataagaatgataaaattctggatcgtgttttattttgttagacctgtatagtatcatgcaatgtcaccgatgaatgaccgaatgcatagagctttagctttggttttcccatatctgaaatgaagataatgcattcctcaacaccaagtctcaaaggatgcagcttattcctggctacctgtccaaaatattaccagatacataagaaagctgataagttgttatcacacttatttgtggcacagtgtaagtaatatggagtttggagtagaaagtctcagggctcagtagattgctgtccctattaggctagttatacaccctttctgtgtctcagtttcttcatctttgaaagggaaataataatgcaggcgcctgttgcgtgctgaggcaggcctgtgagtatcctaagcagttatatccttagaaatgctgcgtgctactcttattagtatgaccattactgcttacaacacaatgtaccatttgatgagactattctaaatgagtcaagcattgtactttagagctttatgtatctcatttatctgcataacatcactgtgagctagttgttattatttccattttacacataaaactaaaacccagaaaagccaacctgttaagtggcaaacctggtatttgaactctttccctctgatgtaaagatatgttgtatttatcactattagactctaagcagaaaccttgagaatgcttggttttatgttttattcaactaaggtttattgagaacctgctatataccaggtactatactaagaattgtgcattaattacattatcttcttgtaacagtcctatgagctaagcagggttttttcatcttggctctattgccattttggccagatagttctatcttttgaggggctgtcctgtgtgttgtagga

SEQ ID NO: 2643 - DNA, 1950 bp, artificial
  synthetic oligo
acagcggtgcacagcggtgcacagcggaggcggcacagcggtgcacagcagaggcagcactgcgccctctgctggagggtccgagtgggctcttgggtatgcagtggcaacagcagcgccctccggcgtgtgctttccactcacggagctgggatccatgcactgcaatgcccttcatgcagattgaatgtagacaaatccgaatttttctgatgtatttctatataaaacgattatttacttcgtggaagccttttttttttttttttttttttgaggcaaggtctcaatctgtcacccaggtgaaagtggcagtggcgcaattacggctcattgtggcctctatccctgagctcaagagatcctcccgcttcatttagtgattttttgtagagaccccacctctactatttttgtaggtcccgtgttacccaggctggtctcgagctcctcggctcaagtgatccacttgccttggcctcccaaagtgtggggattacaggcgtgagccactgcgtccagcaaggcttcctttccctaaaaaaagaatcaccacagaatttctgaagataaccaacccattttctatattttacattattccatttaaaaattcaattctatattcatcttcttcagcaatcgtttttgggtcgaagataagcacactgaaatacttatccaagccattggttttacatttttatacttgcccatccagcagacaataaaacagaaagagaaacttttcaaaacccaaagagatccccctctctcagggctgctgtgtacgggtacacaggttgtgcactgtacaacttcaggaggcacacaccatatggacagtaatgtgaatcatagcccttcattgatgcaacaaggtgggactgctctggtgctaggtgttgcagaagaaatagagaagcctgccttcacttgtgtttctaacatgagtgctggtgacccacgagctctgtcgtgaaacaccccacagccaactctaacggttatcacttcaaagccagtgctgtttctcctgggatggcttcgtgctgcttctaggtcatttttccagtcatataaaatgcgtatctttcttttgtttttaaaaatactttctctgagaacgttttaaaaaaagatttgttccagctcatccatactcaagagaacttcatgttttgtaccctaaacttgaaaaactcagataacagagagaacgtaatgtttgtgtttactccatgaccctttatgaaccttcagtatcatacttgcctttattcttctgagcaaatgctgattctgcttgtattcaaattcgtgtttgacctcttctgaaatatatgatcagtattgtgtttcaaatcgccttcgaagtgtacttacttgtgagtgcaagcctctcctcagctggagatcacacgcagctccttgggagggaagggggtctgggtccaattggattgcttgccctcatatagaacacagaactcataaaaatggatatgtgaggaagagaggtgctaaactcatcatggccagtggtccttacatttcttactgcaactagctcttcagcaaatgctaaaagccatctttcaagatcccgagtctggccaggtgcagtggctcatacctgtaaccccagcactttgggaggctgagaccggtggttcaaaaccaacctgaccaacatggtgaaaccccgtctctgctgaaaataccaaataataataacaaaaataaaattttttaaaaatcccgggtctgcctgtataccccgacaccatcaccaccggggatcacatagactactttttccttctctgcttctcttaggtgcctagaacatcggcactctttggggtttcaaacgttcacttctaacttggcttttgtttcttttttgagatggaatttcgctcttgttacccaggctggagtgcaaag

SEQ ID NO: 2644 - DNA, 1450 bp, artificial
  synthetic oligo
tgtgacagcatctaatatgaatacctgctttagatatgaaaaagaaacccttagatatgaaaaagaaacccttaggatcataaactcaagaagaattttttgtttttatctagtcagattgctgaggtcctggctgtttagatgacttacagaaagaacttgggtagtagagtcaagatatgaatagtaacccagttttattactagagatttgacttcgttgagcatcagctttcttgtgggcgagttaggttttaacaatagctgccttgcaggtgttttatttttaagcattatgaatgatggtgcctccagttccataacaagatgaaggcatatgcagatgtgagttaacattttcattggctggccatgtatgttgaatcccaaacaagtggtcttcactacacctcaccactcacaaatctacttatgagtctcagatggtgagctagatggtcagtaatacccacctcaggaaaactgcttctgagtttacaagacagcaggcggaacagctcaaagaccaatgcatgcataaatagtctttcctttttttcaccaggtcaactactcgattatttgcactgggggccttttttcaaagcatctgaccttttggactcgtctggtgaaatctagtatgtacttaggaccagccttcaacacaaaggaaggtttttgttacattcgtttgcatatcctgtcaaggatatcttcagaacactttcatttcacagtaaaatgaaacttacggaagaactaagcagtgaagtgcttcatactttcatttaaaaggggaatgagaaacaaaagacaaggttaattatgacaccggggctttacaatgctaaaaatatcctatatacaaagggatatgtaggctgtgttctttttccatgtcattacaaagaacaggctcaaggtatctgcaaatttctaataaaaatattattacttgaaaaatgtccatggttgtatctaactgaagggattaaaacttttagacttgttatacaaataccatgatacttgtcatcaaagtcctccttttcatcaagcagaccctgacttacagcatctgagagtggaaaaaactagcatgaaccgtaaggcagtgggattcatacctacctctcactcacacgttcatccaaaccaagcaagttgcataaagcaacctgagactttatacttccacatgctggcaacacagcattaactagactcgggcaacttgtttaaggggtttatttaggttcctatcagtaaagaggtgtttttccagctttgggagaatatgtatgatgccaagtttttttttttttaagtttaaatacttttataagtttaatgttggcattggatgtttacatattaactggtacaatttacatcggttttatacttacctatttttgcaaagatgtcatgtacacaaagatacata

SEQ ID NO: 2645 - DNA, 1100 bp, artificial
  synthetic oligo
agattgagtgtgggcaccacacaggtggttgctgcttcagtgcttcctgctctttttccttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagctttattgtgtttcatagtttccgttcttcttctgtgagaacaaggataatggcattaaaaaatcagcttttggtcattataaattgtcttctattaaaacacatatacacataaaatcacttgaagacaatttaaacatcttctgaaatggatcaagaggaagggaaactgaaaataatgcaactcagaaaccacagagta

SEQ ID NO: 2646 - DNA, 3400 bp, artificial
  synthetic oligo
gcatatactaccctaagtaattagagaggtcagtcacaaaatttaaaagaaaagaaagtaaaaaagaatataatctgaatgggttttttttgaagaaaggatagtaattatataaccctgaatttgtcatttcaaatatcattgataacttgagctaggaaggtgagagcaccgtgagttcatatatgcaaatgtaaattctcaaagccatacgtgcatgcctaaggcattcctctaaggttccactgactttctctgtataagctccgtgttataacaggtgtataaatatacatgcaacatgcatcgagaacaaacatattggcatctaatgtttggaaccttccgcctatcagggcttcttttctgaaataagtcatgaagtttcccaacaggagagatggataccaaaaataaaatccatttaagtcctcaacccattcaaataataaatccttcagattagaaagaggtgaggtcaattgaatctaacatagacattaagaactatctgccccaaagaaggctactccacacttttgaccatattcctttgaaacagggaggattcatgttctctctcctctcctggaagctgacagatacccatgtatgatgttgacatttatgtatgtctagaatgcctaaggcatttggcttggccaaggccggttgtgacttggccccctgccaccattctttgtaccacaggtgtttccaagtaggatctcattcgagttgggagggtgagttagggctttagaccacaggagcagctgagggaaaactgtaaggggccaggcttagccaagaaaagaaggctgagaaagatccaaaccagacagctggctaccattctaacctctatccccaccccagcgctaccacacttcaggccacaccctacccagagtgtggttttcaaaccacaggctgtgtcgtaggaaatcaatttattgattcttgccagcattgaaaacaaaaattaaaaaaaaaaaaagacaaaataaatcactaaaaagaaatcaagcaagaattttcagaactccccagcatggtaagggtaactattgtttatcaaacttctgtttgagttatttatgagggggagagatgactgatctgtgatgtacaatgtttctttcagtgtgagtcagactcacacttgtcaagacttccatcccccagcctcctgcctgcttatggcctcaattcctttcttttctctgtctagcttcgactcctaatcactcacttcagattgattttaaaccctttcctccccatgtccagctgaagtcttccttcatgccccagtcctgaatccactccaagaacctgtttgccattttttcacccaggctcccaagtactaacagataaaatatacactttgccatgctgtcacctcaaaatttgtcacttgttcctggtcaacttactattagctgtgccaccttcagaaacttcgtaacttctatgagcttcactcttctcacctgcctaatgtggaaggggatggccatgacacatggggttgctgtgagagttgaaggaaatatgtacattgtaggtgctcagtatatggtctcctttattattacaacagcctcttagttcacaaatcaatgcactattattacatgaaatacttcttgacctctttgtagccttgtgtgtgtgtgtgtgtgtatgtgtgtgtgtgtgtgtgtgtgtgtgtgtgacagggtctcactctgtcactcaggctggagtgcagtggtgcaatcttggttcattgcagcctctccaactcccaggctcagatgatcctcctgcctcagcctcccaagtagctgggactacaggtacatgccaccataccccagctaattttttctctgggtagctgtgatggttaatactgagtgtcaacttgattggattgaaggatgcaaagtattgatcctgggtgtgtctgtgagggtgttgccaaaaaagattaacatttgagtcagtgggctgggaaaggcagacccacccttaatctgggtgggcacctttaatcagctgccagcatggctagaatataaagcaggcagaaaaacatgagaagactagactggcctagcctcccagcctacatctttcttctgtgctggatgcttcctgccctcgaacatcagactccaggttcttcagttttgggacttggactggctttccttgctcctcagcttgcagatggcctactgtgggacattgtgattatgtgagttaatacttaataaactcagttctgtccctctagagaaccctgactaataaagtagcttttgacaatgctgaccacactctactttctgaaaccctctcctctctcaccatttttagtctctggcttctctattccaccaacatctctgattgccttttctctcttaccccgtaagtgttgttgctccctggtttgaatcttttgcttacctcttttggtgtctgacttcactctacagactagaggctaggtctttagtttctagatttcttttgagttctgagcttcacctcgtcttatctctgcaaacagaaaccccagatagctgctcattcctgctccaactcttgcttctgtttcagggcccagtgtctcagcaaagacttagaacatggtgctactttcttcctctcccaagaagtcatgtgagtcactgtgttaactttaaaaaaaaatcgtaatttcaaatttacagaagagttgcaagaatagttaaaagaattccctatatcctttactcagattcactaattgttaacattttaccacatttactttctctctcacctcttttttttctgaaccattttctgaaccctttgaaggtccctcagcttatatttcctaagaacaagaatattatcttacataaccacagtgcaatgattaaattcaggaattttaacatcaatgctgtgatattgttatctaacataaagtccatatttaaatgttgccagttgctccattgtcctttacagcccttttcttcctcctcatctgggatccaatccaggatcatgcatcacattgagctgtcatgtctctttaaccaggaacaattcctcagctgctctttttctttcaagacagtcacatttttgaagaatatgaaccaactggtttgtagaatttctatcattttgggtttgcctgttgtttttttcatgattagagtcagataattcggggtaggaaaaccgataaaggatgttgtgtccttcctggtgcctcacatcaggacgcacgtgatgccgatttgtcccattcattgataacttggatcacttgtctagatggttgccaccagatttctgcattgtaaggctatcatttttcccactgtaattagtaagtaacctg

SEQ ID NO: 2647 - DNA, 1100 bp, artificial
  synthetic oligo
ttggtcaggctggtcttgaacccctgacctcgtgatccaccgacctcggcctcccaaagtgctgggattacaggcatgagctatcacgcccagctgcaatattttaaatatattttagtataaagtgaagggcctctgacgtccatctagtaagaatcgggccacatattcatagactgacagtttcaatctttgcagactttgtcctttgaagtttgctttgctttctcttttcacactttggtagcatctttcagttctctgctgctccagagaggaacattatggcctcttgattggatggataaagggtccagccctgacccattggctgctagaagggccaggggcaaaaagatgaccccattaaccaccttttccacctgtacttcagtcttacttgcaaattgttttttctcatgtcttttcatcatagtctatacaatcatcttgtcaacaagttatcgtaaaaattgttgaaaaggatctattaattctcagcccagaggctgtcctttggatttctttgtgactattgctttggtcttacatgtggctgatatcagcttgttttgaaaatccaaacactagtccacattttcacctagtaaagtcattgatgccttctttgtggccagttataaggagctttttcatctaattcatgatgacccaggaaccttacctccatgacaaaaatgttcctggaactcagcttcccaacgtcatctctacttcagttctttaggttgccagatgttgaagataaatcactttaactgtggttgcatagaattggttgggaatcacatgagtttcttcatgtaaaaactaccaagacctctgctttgggtctagatcctggtttatgctgccttcttcaaaactaaggggagatgctgggacttgctgttagctccatttttttttttaattgcatgattctctgactttgctgaggagttgtagatccaagttcaaacatacattggcaactacacccaaatgcagccaagatacaagggtctacatgtgatacagggtctaattagccatgtgactttggacaggtcattctctctggctttgattttctcatt

SEQ ID NO: 2648 - DNA, 1950 bp, artificial
  synthetic oligo
tttgattgcagttgaaattaatggtgcaagaggttttcttttttgtttgcttttttcttcataacggaagtgtaatctccttgcaaagcttgtgagcatgcatcctaaattgtgaacttcatctgccatggaagggaaaaccttgacccaataccattgggatctaaaagtgtgattcctaggattctgagcatactacacgagatttaaggcccctttcagactctgcattaatgcttgttcagtagtgataaataacattgattggtattgagaccagattaataacagaaggcagctaaaaggtattccctcttagcctaatttcccaaagggcatcactcagctgcattagtggggcgaggctcttccttctctaagtggtgtctttagaagcttgagggattattgctcaggggaaaatggctcaatctgcgggattctttttctttttgagatggagttttgctcttgttgcccaggctggagtgcaatggcacaatctcggctcaccacagccttcgcctcctgggttcaagagattctcctgtctcagcctcctgagtagctgggattacaggtgtgcaccaccacgcccagctaattttgtatttttagtagagatggggtttctccatgttggttaggctggtctcgaactcccgacctcaggtgatccacccgcctcagcctcccaaagtgctgagagggattcttaagagcagctgagaaagggccctgcacttcagctggctccagtttgtcatcctttgtctggtatcttcagacaagacattgcaataagaaaaaataaatacagtgtgagaaatcaaatggtttttgtcaaagtgtaaaagggactgcatctgactaacactggagttggacagaagccataaaggatgttttgtgtgaatgtttccggctgcaaaatctacctgactgttgcactgaaaccacaactatctatcacatgcttgtgagaaacccccaggagcttcctgtttcgtgtgggtcgtgagaagattgcacagcacagtacagctttcattgtctttgagctaatcttaagctaggagaaggaaggagaattcacattttgtatgtttagttatttgtgaagtctttacacccataaatcgattatgtataaattagtatacagattcactaccatggagaggatactgtgtacatctgaggatactgtgtacatatggttgagtcacttcacctaggccttggggaggagttggggcatctccagggtaaagtaatgtggtttagcacggggacttccaaggaagcatcagtatgagataggggaacatggctgaccaacggcaagatgatgccccatgatggagcagatgggattggcgtgggaggggtagtttgtgagaccagaagacttgcaatctctcctgctgagaccaataccaaccaaagaataattagagagcatggaggacaacatgatctcatgtgaatctcacatcataccttacaagttaactctgtgtatcgcctaaggaacggctgaagcttcttttcttgtaaatgacaatagacacatatccagtgccattaaggacagcatctggtcacccagtggccaataatgtcaaagttctgatcacaaggtgagcagtttcctgaagatagaagagtacgatggccacagccatgggttccaacatagccactctctggggccaccagacaccctcctcacactccgcagagtttgcttaaatgtgctctgagctggatgcatttgctaaaggtttgtctcttcccctttgttaacccaagaaaacagaaggacgtctcagctagaccccagccgctgccaccccatctcttctccaactctgctccggcagctggcgtttcctgtgttctctcagtgggttaagagaatggtggtggcacattgtcccttaatta

SEQ ID NO: 2649 - DNA, 1050 bp, artificial
  synthetic oligo
gaaattaggtcatgagggtagagacctcatgaatgagacgtgtgcccttataaaagaaaccccaggaagttgtcttaccctctttcctcctgaagaaggatctcaccagaatccagtcatgttggcaccctgatcttggacttacagcctcccgaacgatgagaaataattttttgttgtcgttgtttaagaagcccgttctatggtattttgttatagcagcctgaactaagacagtgaatttagccgcacattaaagagaagatgaccaaggcaaaaagatggtgagaaatttgcccaaggtcaccagtgacttagcatcagttcaatctggaactggatccccaagaccccaagtctcatgcacttttttccaccagtgcttctcaaaaattaatgtatactcagacaatctgggaatcctgttaaaacacagattctgattcagccagtctgggggaggtgctgaaattctgaatttctaacaagctctgagaaggcgccaatgctgctcgttcatggaacccacttggaacagtgagggtctataactggtttcatcaacctctggaacttatgattccttgaagctaaactttcatcagagttcgaagaaaaaaaaagtgtgcaaaaaaaaaaatcacaaaacatataatgagataactcccaaagttattataatctcactactgtgaagttacaagggagtttattaccaaaatacccatcgaacttcaaagtgtcagtacaaacaggcaaccctcaattttgccaaggcctacaatcaatgaaaagtttctattctgttgcctgattggaggtcctgctgggagacacaaaagtcccttccctccttcccttcatttagcaccagggagttcattaccaatgggggctccatgcaaaagaacatttctctatcttctgaaaattgattgctccctctctctgtacatttgtttttcatttacacagatatttcagctatttttgatttgtggtgtaacctaggtaacctaaatcagctaaaataagaactaattccaacct

SEQ ID NO: 2650 - DNA, 1300 bp, artificial
  synthetic oligo
tttattatcttttgacaattaaaggatgacataggcaatgtgttttgatctctcacaaaaactatgaaattttatttcttctggcgaaacatcttttccaacaacattcaacaaattaacaagagcaacttcagaatgtgtgttttttccacctaaaaatgcaaaaacaactgttctttttggctttattaagctaaacagacttgatataagtctagcctttcctgctactgaataatctcatgtaatatgaatacagccaccgaagagctaataattgctaattatatccctcaactagatttcctgttaaccatttttaacttgggtttccccagtgggtaggaagcattctacggtgtggtttaccagagaagccctctgaaatcccctttcgtttgatagggtaaagccaaaacctatctttgcctgacaggttcctatatatacacacatatacatatacatatacatatacatatacatatacatatacatatacatatacatatacataatgtatatgtatacataacatttataaatatatgttaatatttataaatattatatatataatttcaacttttagattcatggagtacatgtgtaggtttgttacatggcgtattacataatagtgaggtttgggatgtgaatgatctgatcccttcacccgggtggtgaacataggacccaacagttagtttttcaacgctagcccctctccctccctctgtcatctagtagtccccagtgtctattgtttccatatttaggtgtctgacaggtttcaagagccctgcagtgacaaatagactaagtaaaagacagggacatggttttggcagaagactgcatgagagacacaaaatggatgttcataggagtcagatatgttgagggcttaagaataggatattttggactatctttatgccagtagctctcaactctggcttcatattagaatcacttggagatctctttaaaaagcaccaaaacctgggttgggccccaatctcagagtttctgatttagttggcctggggaatgaccagggcatagggattttttaaagtttcccaagtgactctaatgaacattgagggttgaaaaccactgctctagaccaggatttcttcacctcagcactattgatattttggactgcatcattgtcccgtgcgtggtaggatgttttgcagcatccctggcttctacccactagatgccagtagcaccccttccccagttgtgataactcaaaacgtctccaaacattgccaaatgttccctg

SEQ ID NO: 2651 - DNA, 1100 bp, artificial
  synthetic oligo
gtgagccaccacacccagtcctacagtttgatcatttttaaggtgcaaattctattcaacttcccatatacatggggtttcacactgggacggtgaggcaggggatcagaggtggggttaagtattgaaatcagcatataaggcaagaatagttgataatcaacactactctctaaaactccttaaatcagtggtgctacagagatagtacactgctagaggcaatttagaatattttgttgtgtgtttttggttagcatagccaagggagggggtaccttagatattcatgagccacagctggggattttaagcaaccgtcattggtcataaagtccagagaaaagaaggatcctctccggtccttcagcacttctgaatgccctgctagacctgcattgtgtgtgaaaacctgctcaagattatctgaggatagatgctcacagcattttacaaataaacacaaaagtatttttagcaatcttaataaaccctgaatttttctggaaatcaactactgtatgaatcaaaagtttgtattttgctctgtatggaacttttagcacaaatcattcattgttgtggaaaatcctgacaccaccagttctcaatataacacacctgaatctactggcatttgtaactattgcattcttagttttcctacaactatttattattaaaggggagtactgttctgataaggttggaaatcactgccttgaatttctgtaaatcactgaaatctatgctgcttgaaaccaatgtgtagggaccaagggaaaacttcccctttgccctctgaaggtttgctgaaaaatcaactgacaaaaggcagattaataggacaaaaggcatacaatttattaacgtgcatgagagtcctacaaaataggagatctcaaagaaatggccagataattaattgatgcttttataccatcttgaggttacagaatgaatggggacttgggagattgcaaagcacgctatgttggcaaaacaggttataggagaaggaggagaggaggcctggctggcaaaggtggtcttgttaacacagaaaagacctcacaggtagcagctctcagagagaatag

SEQ ID NO: 2652 - DNA, 1050 bp, artificial
  synthetic oligo
ttacgcataaatttaccatacatcccagcaattatacaccttggcgtgtacacaagagaaatgaacgcatacatttacacgaagactcatctgtgagcatccatagcagcactattcatagtagccaaaaagtggaaacaacccaaatgtccattaactggtgaatggatcaaaaagatatggtatagatattcaaagaaatactattccataataaaaaggagtgaagtaatgatacatgctgtagcacagatgaactttgaaagcatttgctaaatgtaagaagccaatcacaaaagaccacatattgaatgactccacttatgtgaagtgtctggaatatacaaatctacagagatggaaagtggattcacagttacctggggctggtgggagaaaagaggagtgactacagatgggcacaagggaccttattggagtaatggaaatgttctgaaattggattgtggtaatggctaaataactctgtaaatctgtttaaaaatcattgaattgtgtacttaaaacaagtgaattttatcatatgtaaattatacctcaataacactgtttacaaatatccagaatatgaccacatattatgttctctaccattgtcttgttctaagccagcatcatcctcacctggctgactgtcacctggatgaccaattgtcatacagataccacctgctaagtggttgcctgacttccactcttgtctcccaagtacgtctctaacacaacagccagagtgatcctggggaatatgcaaatcagatcaggttacctctctgctcaaaactctctgttggctcctgtctccaagagaaagacaaagttcttatagtggtctttaaagcttcactaatctggcccctccttgttacctttctgagctccctgcctgctattaatacttacccccttgctggagactgcattcagtcacactggcctccttgctgctctttggtcataccaggcacatttctgccacagggcctttgcactggctattgcttctgcctggaatgttcataccccaga

SEQ ID NO: 2653 - DNA, 1800 bp, artificial
  synthetic oligo
ctcaaaaattaacaacaataaaaaaatacagagaagcacatcctctgcgcttcttatggcttctctaacgtttattgtgggctgtgatttgctttaattttcaggacaccttgtgacttgcttagcttgcatagttgataagctgtaaaattggaattataaccacttttagttatcttttcctctacctcactcatacagtcagaaggatggggttatctgacaatatataaattatactagtggtcatagtatttgtcagtgaacatgtgccttgtattccttcaagattcagcaaagccagaatcaaaagagctaaaattaactatgtgaggcaaaaagtgatatagggaaaggaaaatatggacaactatggtaactttggcttttctgtagtctgagttttgtgtatcagtgaataatatctcagtgctacgacattatgcccatgtggtaacatttctcttcagtgtgtgggaaagcatctggcacataaaaagtgctcagttaatatttgttgtaaatgtgtcacgaggaaatgattcaactcaggtgctctgggcatttcttatttggcctcttttattgcctttctcataatttgtcatcgatattccattacataatattgcaaaggtttcttgaggtaatcctttaaacaaatcctatttttaaaaaatatggcagcttttttatctattgattttgaaatgatgtattttacccacatcttctatgtcagtttctatactaaaatagctaaaatggaagtgtctgtagttgctgaatttttaggaataaatgaattaaagtatgtgtgttaattttacatagttatggagctagtgaactatttggtgtcattgtgacagcttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttggcagttggctctcaggactgtgcttagtccctgagcacaaaagttcttaccttggttgggggtgggcagatggtacaggtggattggaagtgaccgtctgattatcatttgggattgagtctgttgtgtgctgtgtaaatttaatttacccctttgctctttgtgtcagttgagaccaactgaaaagtgattgctttcagtaagtaaccttatgataacacgacgcttcattttgtgtgattgagttttgggacccagtttataggatcaaggaagggttttactgggcattttatgttcaggggttatatccctggctttagtattgaggactttgaagtttacaagttgtcatgtttagcaccctcaggtgctcctgtgccatagataagctcctgcactgataacagtctttccagaaaaatgcctgaggagctcatatttagtcattctgattctcaggtatcaacttgaactgaaggatgactacatcattagaactaatcgactgattgaagatgaaaggaagaataaaggtgatgtttggggggaaaataagctgtatttttcagttctgctgtaggttattagcttcccaagttgggtcttttctatattctaaaaaatacagcttacacttcattgttcatacaaaattacacattttttgtaattttaattttataaattaaaaatcatggtcttcactgccttttgaggaacctt

SEQ ID NO: 2654 - DNA, 1100 bp, artificial
  synthetic oligo
aatgttttcaagggtcattgatgctgtagcatgtgttagtatttcctttctttttattgctgaatcatactgcattgcaggatataccacattttgttgatccactcatcagttgatggacatttgagttgtttccacctgttggctattatgaacactactactatgaacactcatgtacaagcttttgtgtgaacacaagttttcatttcttttgggtatatacctgaaagtagaattgttgggtcatatggtaatcctatatttaaccattagagaaactgccattatgttttccaaagcagctgtaccattttacgttcccactagtagcatgtgagggtttcagtttctccacatcctcaccaacatgtatttactgtcttttgatttcagccatgatagtgggtgtgaagtgatatctcattgtggtttcaatttgcatttcccaactaatgatgttgaacatctttcataagcttattggatatttgtaaattttttagagaaatgcctatcacatcctttatttttattttgggttgtcttattattaattttaatatattctggatgcaagtctcttagatatatgattttaaatattttctcccattctgtgagttctctttttactttcttgatggtgtcctttgcagctcaatagtttttaattctgataaagtccaatgtatctattcttttcctttgttgctattgttgcatctaagaaaccactgtctaaaccaaggtcatgaagatttactcctgtgttttcttctaacagttttataattttagtttttacatctaggtctatgatccatcgtgagttaatttttgtgtatatgaggtaggggtgcaacttcattcttttacatgtggatatccaattgtcccagcaccatttattgaaaagagtattctttccccactgaattgtcttagtatccttgatgaaaatcaattgactataaacataagggttatttctggactctcaatgatatcctattgatctatatgtccattcttaggccagtaccacacggtagctttgtagttttggctattttggcattgccaaattccattttgaa

SEQ ID NO: 2655 - DNA, 2200 bp, artificial
  synthetic oligo
atgtaaaaactaaaaccaaaaccaaggatactgccagaaccagtgaagtatgcacaaattaacataaattggcaattgaaatgtggagccaacaattgtccaaaacacaaagtacttccttaagaacaggtctctggctcgggcctttgcttcatgagaactgcacccaactccacacctgtttaaaaatgaagcccaccctacccctaaatcagtccaaagtattgtgaaagctgttctggagaaggtccccgtgtgataattccacgtacaaatccaaacgcctagcgttaaattaaaataacgatttcagaaaaagtagttgatgctttcctcaataccacacttgttcgtaactgtaacatctttggtggcaattatcaccaaagtgatcacaggctgagtagcagtcatcctctgagcctcattttgtgtatgagcctcatttaaaacggaggttgaatggtttgactgctcacatgggggacattaagagaagtaggaacctgagttacaggccactcgattctgccctttctagaaggatcttatgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcc

SEQ ID NO: 2656 - DNA, 1900 bp, artificial
  synthetic oligo
gcaaccaaaaaagtaaaataaaaacacaaattcccctaaaaactagaatgtatacttgaactagattttcctatcttccttttctactagaattctaaaaatacatgaaaattcacctgctttgatctttgcacagaaacacattaaaagccaatcattaaataagttactctggctaaagccctgaaagtcaaaccttccctacaaagctccagtgatttggttctctgaaccaaccaggtaatttggaggatttagttaggtcttcagtacacactgtttcaaggagatctgctggacactgcagcaaaataagtgaaggtatggtgagaaatctgagtgagatagattgagtcatatgcggttccaaggaatctctctgtacatgcaataataaccctatcacagaagatgtcttccaataatacacacaacagtaagaacttcctcactaagacaaagaatataatagggttttgttgagggctgggcttcctgccccacctacttgggcagccctgcccccatccctggctggttgctgaggctggcaagctcatctggcttgatgccctcatggcctccctcctgtgtctttgcatggtccctgcttagtgatttggacatcaaagatggctcaagtccaaatggccttcttccacctgcagacatccaagctccatcttgggcaggacacaggcctactcaagtgcacatgccactgtgttcagaaagcctgcatctccccgtctataatagctacagttaaaactgataggcaagggagccaaaaaactgagttttattttcttttcattccctcaatccccaaccccaatttaccctcttctggatgttgtaataagtactgtcacaaagaaggcatagcatggggaaggagtaaggctgaaaggatgcagttaacaattctttttttcatacaaatgacattccacccacagaagggcattgtttaatttgtcagcaagtgtgatgaatttgtgaatgggtttatttgcaagttctctgaatccccttgtgactaatatcagaatcaaaagtgaaatatgaggccaggaacaaagttaccctctgactcaggaacacaacaagcaatgggatgactgagaatgacataatgataacatagttcaaaagaggaaacagataagtttgtttcacagcaagcatgtccttcataagcaaaacctagtgtgaccataaggtaataagggttgaataggcaggttctgcaaattaagagcataacagcaaaaaccatggctagtttaaagtagttaagatcgctagtacatttcaggcgtcttatttcaaatttacttttttctataaacatattcacggtaattccatgttaatctctcttttctgaatttataggcactcactatgcctcatttacttgggcacttactcagttacctgtaggcatggattctacaatctactccttttaagtttcctattttccttccagcataaaaataatagctaatatttcatgctcttagatgctgctgaaattgttgagcttgtctgttgtttcctgataacgttctctcctcctgcatctactccccaaaatctctgaggacctagtaactcaaaaaactgactataaagcaccaaatcttttcaggaagcaaatatttaaatacattatgttttcaaagatcttttcaattcatctgatatttgatcaactacattcttttttcacttgtccagctgttccgtggctgaatttcctcttgtagagaagttgttcaaaaaaagttctgtacctactttgcaaactctccaatttacactctagccttaactgttcaaaactttcccccgtcattctcatctcaccctatcctttaaaaaaaaaccc

SEQ ID NO: 2657 - DNA, 1050 bp, artificial
  synthetic oligo
aacaccagccccattccccagccttctctaggaagccagctccctaccacactctccccattcttgctctcagtaatttctccccatttttaaaaaaacataaatctatacaatttgtccttaattgaaatgagccagagtctcccccctcactgccttcttattctgcattttcttctttttgtttcccacttccaactctcatttaaaacaatcctggtagtggcgaggtatagtagagcaccagttccgaagcctcaatctgaatctcatctcgccacctagtggccacgtaacccttggcaacacacctttggaattgcactttttcagttgaagtgcggtgataaacaattttgcaaagaggagtattttataataaagtgaaataatacatgtggaattgttttgaaaattatctattactaatgtgaagttatgataactagtaagtcccctttttattgggagtttgggttgggattttctcttacttgaaaatataagcaccacaaacacagcttctaattgatattctgtttaatcttctgccccttccaccccttcattccatcttctgccatccaggacttaactcagatcaagattaactcagaccaagattcaggaacagagctaagtccttaagtggcaaagtcaaaccaggaatttgactaacatgaagaattgggaagaaccacctggtggcactgaacctcgtagtaaatccaaagaaaaggtaactttaaaggattctggaagatgaagcaacaggctgagacaacaggaatgggaaagaaagtctcaaacagagctttgcagtgtgtctgagatcagccccaaagaccttgttttcttaaggacatctgactgaaatgtatttggactcagctgtggatgttctgtagaagcaagaaaaaaaaatggtttttttactgaagaaaaagtacaattctgtaatcttgttctgaatatgttttctatcctgagattccttgcccatcagggaaatagattcttgtactttgaacagctgcctgagagtggaat

SEQ ID NO: 2658 - DNA, 1150 bp, artificial
  synthetic oligo
acacacacacacacacacactacatcttttaaattctttcaccctcatcagggaccagtaaaagattttctaaaactcaacaaatacctttgacatttcacccaagtattcactcgtagcttcagcaatgatgaaaaccataggataacatattcagaagtcttcccttgtgctggggtggagctctgtacctatgtataaacagcctatcttctacttgggcatagtcaagaaaagtaataactggttaaaatctgcccaacagtcatttcacaaactgtttctatagtatttagtccaatagttcacaacgtggggtaatttggcaccccagtgaacattaacattatctggtggcatttttgacagttactgttgttcatgtgtggagggtgttattggcatgtagtcggtataggcccaagttgctgctaaacatctaacaatgcacaggacaacccctcacagaacaaagaattatccagcccaaaatgtcaacaggttctctacttgagaagctcttacaacctctgtcaacctttaacacagtttacgcttttgcacagttcaatgtcctaaaatgtgctctcctaacaattatgtaacattttagcctgcagacaacttcagtgcaactaaagttcccatcataagttattcattctggaaataaaggcatggatactatcaggttataaaggcaaatcaggccccaaacctaaagtaaccagcaaaatcagcaatccacagcccatttttgactgtttctaaaattctttattttaaaaaacaaacaagccaacctaaataaacaagccaattttcttcttgtaatttcatttcctgttctcagaatttcaagtttctaagagttagtgtcatctgatctcactttcggcttgattttgttttcctgtgaaaggatatgtcatatcagccctcttgagtttctaaatgagagaatctaatattctgacatatgacatagcaaaaactacgcctccagatgaaatctaaatctgaataatcagaaagaggctacgctggaaagggttatgtcttttcagttctcatacagaaagataccctttattcttatccacctcattttcacaatgagttacacttggaagaaaatggcatcctctca

SEQ ID NO: 2659 - DNA, 1350 bp, artificial
  synthetic oligo
gacatacaaggccctccatgaactggatcatagtaacctcacagactcatcttctgtttcttgctttcatatatcctgtgtgttccatttataccaaatgacagcactttctgttgccctgatattccagtgcctcccagtcccatgcctttggccttgtctttccttctgccatcccttttccctgacatctttcccaatgtctgcaggtttagctaagtgtccttatcctgtgcatattgctgtccgattctttcttgcactgattacatttgtctgtttacttgtatgtttcccccattaagtaaaatgtcctgaaggagaaggagcaggtctcattgttctgatataaaataggcactcgatggatgtttgttgggtttatttggtgtaataaaagggtcctgaagcaggccgatgtatggagcttctgggaatcccatccagcattccaagccattgggttaaaccatatgttcttgccaatatctgactttaatgacatatcaaaatgagaatctcgtgcggttcaactttatagtttaaacttttctgtaatgcacgacgtttgagaatgggtgctggaaggctaaatctgagaagtctccattttgaactttgtggagagggaaaatgtgagctctgtaagtcatatgccagtgaggcagatgccgctttggggtaagacaagagtaacttgttaaaggataaagaggctttttaaaaattcgcaatgatcactaggtggcagcagaagttcactaagaatacttcagacaggcccaaggccattgttggacagggttgttcagggaaacacaatccacaaggtgtttgcagaacttcagcaggctgtttggcagagtctgtgctcacatccttatagccaagttaaaagaaacaaaaactggatgcaagagaactggtggtggaacagcaagtagctgagggtgatatcttgaagtattatgtattgatttccgtccctagagagtctgatgatatgttctgttctcagctttgttccttttaccatttttatcaataaactgatagaattttttcaaaataaattcttgaaattgtagctctcttcaagaaggaagggatatattaagtattttaaaatacagaattgggacctcctcaatttattcttttgtgtgtgtgtgtgtttgtgtatatcgtttgttttaacaatttagagcaatgacctgactctaacaagactcaattaaattagacttggattcactaacctaaatgtgctcatctgggcaagagaagtcactgtagaaaaggcagttggcttaacagtcacatgtgcggaaaaaaagtatagtgagcagt

SEQ ID NO: 2660 - DNA, 1300 bp, artificial
  synthetic oligo
aggcacaactataatctgcattttaaaatgtccagttgtgaaatacacccaaattgtctaagattctgatttctctctatgccactgcccatggttctgtgtttggtttggatcaatactcactctggcaaccacactgcacattattcagtcatgagtttgcagacattccaatcccagttcttattctccattgagtatacacctggtatggtgaagatgatatcttcaagttattccaggaagaggagttgatgactgccttagtccattttgtatgtctataaaggaatacctgaggcggggtaatttataaagaaaagaggttttgttggctcatggttctgcagactatgcaagcatggcaacagcatctgcttctggccaggatctcaggaagtaaaagctttttggatcccgacccaaatggtggaaggggaagggtgagcaggagtgtcacatggcaagagagggagcaagaaagaggaggaggagaggtgccaggctctttttaataaccagatcttgcgtgaattcactaccatgcgggaaggcaccaagccattcatgagggatctgaccccatgacccaaacacctcctactaagccccacttccaacattgaggatcatacttcaacatgatatttggaagggacaagcatccaaatcatgtcaatgacaaagtattttttaaatgggcataaggtaaaaatagaacaataataatttaaaatagaaacaaaaacaatcaatcactatgaatcctataacacaacctatgaacatttttaaatgctgtatgatttcaggcaacatatttaaatttgcttagcctctgtttcttcttttgttgaatgcaattagtaatacttgccttatccctttggatggagatccaaagagatatgatatccatccaaagggataaggcaagtattactaattgtagttagagttaaatgaaataatgaaaaacagtaagaattaatgaataaaatgagacctgtgaacaatacaaagtaatattgaaactactcaagtccacaaactaaaggaaaaaaaagatttatttaggaaacatattttactttatatataaatattcatatcctcaatgactaaaccttggaagttagataacctatccatctggaaagacacatagatctcgcaggaaggtggtagaagggaatacgtagatttatcaggtatctatttgaattcttagcacaaagataaaaagaactatgaaactatgaaaaaaactgccaagtacattgatttctaaccccccaca

SEQ ID NO: 2661 - DNA, 1800 bp, artificial
  synthetic oligo
gtcattattaaatgccacagatgcataagaacattccttgtgaaccaaaaagtggtatgcaaatattaggtggaactagtattattttgcccaatcacttagattcttcagccttgaaattcctattatttgctctctaaacaccatctcctttttttcactctatccttcctttgttgtatagtttcctttattttcatccaatcctgatgtgccctactaattccctgacataaattctcattctattggctatccccacttcctaaatagattctcctgctaggacccttgaaaaagacattttgttgtgaacatattcatgtattaatacttcccagaccttcaccctaagcactcactcttcctcctcctatcaactgaaggactggtttaacccagtgccttcattttccctgtagccctcacagatcacaagacatgaataaaatcttttttcacatgaaatatgatatttataattcttactccctaagtggtgagagtcttaacagtattcttagtggccacagtgaagaagcaatttagttcaaactttcttgttagggcagattcaaccatttccaatcagtataaatcctcagtgcctttgcttcagcaaaagaaatagatgatgttcacaaaaacctttgacatttgattatatactcattatcttaagtgttaacattttacagagagctaatgagttattccagtaggtatttatccttggtaaaaagaataatatgtatttcagtaacttgtaaatcttgtgtggggagagctactttgctttgttctagtttatttcctgagctcattttttgagtatatctttgcccaacatcaatcacatgtggtatttgaagttttgacacataccaaaggcacagtaattgaaagaaatacaagttgcatcctcctaattcttgaaagtctcgaattcgtttcacttttgagtttcttacgatcataaggaggggaggagtacaactgtcgggaagtcgggaaaaattgtaaaatacttgaaatgggcaaaacagagtactggactttttcctgattgtcctgctgagagcacctttctaggcaatttccatctcttacggtctttgagctactttgcaaatccctaagttcttgaaaactaacataatgtaaatgattcttgtccatagaaaatcaaatgaactgtgtctagtggaacataattggttactgcccgaaaaatagactgatgcatccttctgtaaatgcattttgccattcctcactttctatatatgggtggttccttgaagtctccttgaaaaagaatttaacatcttactagtgccctcattaactaatgagataaaatttttgatagtaataatgattagtttgcatgagagtcatgattttacctttttttaaaaaaaattatctttttaaagtaaagactatatattgactgaaaaaggtaagctattgggtccctaacttctgcttactcaatgctggtggtaccaccaccccctccagctgtgacaataaaaatgtctccagacattgcgaaatgtctccagatattgccaaatgtctccttgaaggtaaaattgcccctggatgagaactactgatctatactcatctctaacagaaactaacaaaatgaaatctttgtcattttaataaataattcatgtatgaaacagataaaactcttcaatatctatttttaaaaacagttgaattaatcagcaagttgattgactaatagaaggcatatttaagggtgattaccttatggctgat

SEQ ID NO: 2662 - DNA, 1050 bp, artificial
  synthetic oligo
gatagagttctcagagccagggtgagcttaataaaaaatgttttgttgaaaattgtcttttactctgtgctccttgtagctcaatattgtgaaagttcccactgtcttcaaagcagaaatggatggaaggtgggaagagaaaggaacttttacactttatatgtgatcataaaatcttgattactggcatatgtagaagtgtatatagtaaatctcactgccatggagggaaaaattgtaatcctctatacaagtgaaaagggaatactttaaatgaagattgagaatttattgtgaagggagctgtactaactgctatgtaagtggcttcctatgtttgctgccccaaaatactcctgctaattagaacaacaaaccagcacttatcaagtccttttccacctatcaactcctttattacaccatctttaattttctcaattcttgtgccatctaaacttgagttggggaagctcagtctgtgatctctttgactcttgtcttatttcttactggaacatagtacttgataaatctgtcttgaatgaatgaatgaatgaatggctaatggaaagtgtccatcctctaagaatgtccgttcagaaatttctggacagaaaagctggtaataacctcctcacttttttcctgtgaacccagaattgcgaatggagggagtaaaaaagcgtaatcttggagcagggggctgcaaacagaggtctgaatgtggtggtgtctagacaggacctagagagcattagggcaccaagtgcctaggaaaagtcatcaggaggacacatcaggaagtagaggagtgtgcttactccatgtatctccctagcatttaaagtccgctgactttaaatgggctggaaggaacacggttccagtttatctccatatcgggttaaaggacatgaaacctagctagaaggaacattgctccaccactggcccatcagttctgtttcctactcggtttttgcttaacgagttgtggtgtttagagttgggagatacatggagaaagtcactttttaggagaggatc

SEQ ID NO: 2663 - DNA, 1050 bp, artificial
  synthetic oligo
gacaaacaaaaattataccttttgtaaacaatcttcagatctcgccactcaaggaagctgcacattttaggtttccgtgctaaaacggtctgaacaagttctcttgtgatctttttcttctctttgtctgatagtgggacataccatttttgcagtcgaagctttccctgacgactaaaaagcaacataaactgcatctgttaagataaataaaatcaagattacatgtaatactttgaatcaataaagttaagattatgtgtttcacagagaagttttgggggatggggcatttacatgacaaatgattagtagccatcaatatttctatgccaattaaaatagcaagaaattcttttggacagatcttcctctagatgcaaaccttccaatcccaccttgttccacattaagtttgaaggggagtgtgcaggagaaaaaagaaaaatgggtaataagctgaagtgaaatttttgaagaaaaataaagatcactctttcaatttaagaaactattttctacctgtgctatacattgcgcactctctatatgcatcaaaagagaatggtagacatcatctggtttgggtacttttgaaagaaacagaagacctgctatttttcatcctgaggccgttctagttccagggtgaattacttgcagacagtagcttatgtcttggaatgttctcctcagtttatgatggcatattttaagcaaaacagaatgatccaaaatattaactgaaaaatcccataaatacaaattttcattaataaaaaagtatgttttcatctgacttttaaagcattccaacttaaatatgtacaaaatctagaactgagttaatgtattatgaaaaagaaaacaaacgtttaaaaggccacaataagatttacacttattaaataagattcagcattgaaacattacatgaaatacttcatttaaaataaaaaatagtatctacagatggaatggatgctgaattctagtgtgttttatacttaaactaatttgtatgtatttatttgtgatctgcaaatgtgt

SEQ ID NO: 2664 - DNA, 1950 bp, artificial
  synthetic oligo
gagtccaaggcagccgattggaggtttcttcgctgaggggaggtgcgaaccggaagccgggccacgtgacccggaagcggcgtttgccgggcccgagcgcccgcgcgcccgcgcgctcttgcaggtgcctccgggacgcgcgcgggcggctgtcctgcttgtttaatgataggaggacgggattctgcagcgtccttagcctagcgggtggtgcggggcagggaagttccggacagcgaagagccacgttcgagctctaatgattctctgtgtccccagagaggaagtgtgaagtgtgacggctgacgaggagggtgggaggagacgagggagtgctgcaactctggaaaaacaagtcagctcttctgtggagctcgtcacgcattcacgggccttttgctatcattctgcctcaaaattgtccggaatccgccctctccttcccattgcactgctccagccctagcccagacaccttccgccccgagcttcgcgggagtctgttccctgggctcgcctcgcccatcctcggtgctgcggactggatgagttaccgtccgttcggctgaaaagcccggacagcacctcaccttcgagatcccgcttccttcacactgggtcgccccaccagccgcctgggttccagtttagcactgccgacgacttgctgtgcctggcatgtccttgctcccaaatgtcacatctatgaagcctcaccctaaaaccctgtaagagcgattccctctttcacccacatgcccgttagcctttatttagcacaccttaaattgtattcattttgcatctcaatctagttcacagcctggtatataacaactaataaatgtgagttgactgataaagactataaaatgataaatttgttaagagctgtaatgctgagcgtaatgcctgggcataatggatgttcataattttctgaatgatagaatggatgaatcatctagtcatttacagataaggaaaggggagtcccacgggattaggtgaccttccttgaagagccacgggtttcccatatcgaaatgctattcattacccgagtcacctaggttcttacaaaggaagcgagaaaattgcttttgttgggccatgccccttttgcagaggttcctaagtatagtcgccagaatttttttaatggcctaaagtaaaaaaagaaatgctaaaattttcacgaagctaaatgtaatcaatgtaaaggaatcctttattagggattatattctttttgtgtacattatagtatctatgaaactaagacagtagttttgggggcttttaaaaaatgcttttgtatgacaaaacaaaaagaaatgtgtaatacttccccttttcaagcactactgtgctgcttggaaagtttcctactaacatgtatgattaatgtatactggaatattaaagaaaggggacgacacacggcacagagctggctttctgtagttctttaggtccccctcgcccccaccagatttctccctacctagtcatgccccaaaggtgctttcgaatgtcccatttctctcttactacaagaaacagatgccattaaccagttaaaagatagctctaatgctacacaatgaaaactcgccctctgaatccaaatgctgcttttctctttttctgtacaaaacacttatatcctgaaggttcctgagatagccacttccaagtttaaactctgattatgctcctaatgttgctctgaaaatgaggacgggagacttgctgatgacatactggcagtctcctttcctgctcctagccaaaaaaaggtgggggtaggggtagggaggggaaggaattgtgggaaaaataattagcagctgaaagcagctattacataatcttggctgcttattaatttagcagaaggaatggcttattaaattctaatagcaacagcacaactgcaaacaacct

SEQ ID NO: 2665 - DNA, 1300 bp, artificial
  synthetic oligo
aagtcaaatacttttcctctttgggttttgttttacaattatgaaatacgtcatcttagagttggaataaatcccatggtttctctagtccagtggaacgcaaagtgtggtccacagactggtgccagattatagcctcttattggccatgatgattgagtagaggcatggagagttaagtgtttagaaacttttattgtatttgatattgccattatagccaaacacatgatttcatatcatacacaaatatcagaccataatagattagaaattctaagaagtccttcaccaaagacagttcagaaatagtgcaatgtgtccccacagcaaaagtcccttctgcagccaactaagtagaatttacttaatcagtgtagcttattaattcaagcaagacttattcagttcctacaacctgtactatactgtttaagcttgcaggcccgtatcttggttttcacttcctagatacgtggatgtggagagggttcttaatctctctgggccacagtttcccactctataaaatgggtaaataagacttagtctcatagggttgctttaaggaataaatgaataaacctatataaagtactagaacagtccctggtacaagataatcattcaataaatgatatagaagttgacaatgatgctaatgatggagatagagatgctgggtattgtgggtacaattacgtagaggcaacagcctttgctatccagtagctaatgggggagtatagacaaagagacaatttcagtgcagtaagttctgagacagggtgagtacacagggtatccagttttgtcctagagggcatattagttagtgtaaagttgctgtaacagagacctcaaatacagtgacataaagactatagaagtgtatttctctttcacctaatatttccgaagtgaatagttatgttagtaatgtagactgactcctgtaacaaacaattcccaaatctgagagactgaagacaataaaatgcttatttcttgatcacatcatggtctcatcaggtgattagataagtgtccttccttgtggtcatttaggaacccaggctccctggctctctttgggtgacttgtgtctataaagtgggggagaatgaatggattttgaaggatgactaattgctgccacagggatccattaatggtataatatagcaggaggccagaacatggggaaatggggatgtggggatgacaagaggtaaggctgtagaggcatagagagaacagatcataaaagaccttgaatgccaagttaaggaggctggac

SEQ ID NO: 2666 - DNA, 1000 bp, artificial
  synthetic oligo
cccacccaggctaatgaacttcacttggtgagaggtagaaaacatcactgtagtgcaccatatattagcttctgagccagaaaaaaatagaggacatactgaaaaccagttatgttcgtattgtatactactgtggtacttattaaccatcctgctgactcattctgtgacaaagcacctgaatcatgcattagcagaccgtctctgtcattgtgagagagccatttgcctcaaaataaagaatgtctgttaatattctgggcaaacttgagactcttgactgagaggccaaccctgccctctcattagtactttgtgggtgtcaagactttcgttaaaattccacttcctttaatgtggtcaccttggcatgctttttgaatgagtttagtggcttagggaggattggtttttccaaatactaggcaagaatgcagaaagtaattggatttggtatacttcgtagcatttcatcggattgctttgagaagagctcttaaagaaaggctttatttaaatcagaacaaagagggagattcagctggaggcactgatgagcttctatgggattctatgactaatgctgcatgtctataccaggcttccatgtagacggatattatgacattagtgtgtgtaaactccacagtgctgagggaggaggggaagatggtcaccccactccatttaagaaagtttgtaggaatgtagtgagaatccaggaggctgaatggattttatgttgcttcatgaacaagtgagcagaaaacttcagtttttgggtgattttgtatctcagagatgctttcaggcaatagctctgcacccagcataagcaggctgtctcaaccttagcactactgacatttagggccaagtaattccttctgtttttgtttgtttgtttgtttgttttttgagttagggtctcatagggtcttgctctgtcacccacgctagagtacagtggtgtgatcatagctcactgaaacctcgaact

SEQ ID NO: 2667 - DNA, 1500 bp, artificial
  synthetic oligo
gcaacttaataccaaggggacacctaattcttcctactttgttgttgttgttgttgttttgagttggagtcgcgctctgtcaccaggctggagtgcaatgacacgatctgggctcactgcaacctccgcctcccgggttcaagcaattctcctgcctcagcctcccaagtagctgggactacaggtgcatgccaccattcccagctaatttttgtatctttagtagagacagggtttcaccatgttgtccaggatggtcttgatctcttgacctcgtgatccgcccacctcggcctcccaaagtgctgggattacaggcatgagccaccatgcccggccctctacttcttttaagcacacaagtaagtttaacaaagtttcaaaggttcagggaaaggctggccctgttttagatcacttcctccattgaggattgtttctggtgtcaagacaagtttttcatttactcttacatgcagtgagcagaaccaagtgtttataggatagcacagtgtagagctgtgctgtctccactacctaataaaaaatattacacagccaggtacgtaattttaagtttctagtagccatattaaaaaagtaaaaagaatcaaatgaagttcatgttaatatatgttatttaacccaatgtagccaaaaatgttatcacttttaacgcacaatgtaagaatgtattagtgagatatttgacatcttttttgtgtactaagctttcagaaatcaggtgcctgtactcagagcacatctcagtacggattttgccacatttccagtattcaataaccacatgtgaccagtggctcccacattagaccaggcaggcctagagcaaataaaagcaccggaagcacccagagacaccttctcagtgatggccatttaaaaagtaatgttagacacaaaagagtacttacctgatgatcttgttctatgaagttctagaacagtcaaagctaagctatgataacaatcagaaccggggttgagtgcggggcctggggtggattgacagaaaggaggtaccagggaactttgcagggtgaaggaaatggtcaatgttcactttgggataatggttacaggagtgtataatttgtcaaatcccgtcgatttgcacactgaaaatgggacattttgttgtatataaaccatacatacaattcttttttatgttgcccccaaaaaagctattctgtagcagcagcgtagttcggcactatgcgccctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtgcgggcgctggcgcgggcggaggcgggaagaagcgcgtcccggggacgcgcgggacaggct

SEQ ID NO: 2668 - DNA, 1500 bp, artificial
  synthetic oligo
tagcgggtcagcgtgtacctggtttccaaaaacattctttgtgaaactcttgattgacgagttgcagctgcaggagaagggatgtgacttggcacttgctcccagacagggacaatgcaccgaacacagtgtacacacgtaggtgcccatttgaaggggtagctgttctgagttgaagaactgcaccaggttcaacccaattcttgtactgtgcatgtcctgcgtgggggagggacccggaagctgtgccagacctcaggaggcagctgctgtttggccacgtgcattgctcactgaatatctcttaaagttaagtaaaccagtgtagggggaaatgccattatgtgtagtacaaccgtatatttagctgtattagtgattttatctgggtgacaggattttgagtgatctttattttctttgtatttctctgtgtttactgattttgtgtgtgtgtggaaatattaatatattaatgtcttcagaaaaaaatctgtacaaagaggtttagctgtccccccgccccgcccctccccagcaccaggggtgttactggtgaggctgaaatcccaggcagaagagtcagcggccgcccaggtccctcacgttttgtgcatcctgtggcgagggtgcttggggacccgcagaactcaggcggggactgcttcgcgggaagccccaccccgcctccacggttcttcatttctaatgcgcaagcgtgagaacagccttgcatgggtggtaggtcgggcataaactcttgggctcaggctccaggcaggctaagctctggtgccagctgtgtgggggagtgcccggaagggccaggtgcccggcacccagaaacaggagtccccttcatccagtgggaagtggagtctcagtctagtcctcccagtccccacagggggagccacaggttccagcttgtttgttgccaggtgccactgagagagcgcctgggatcattcatcgaataatcctgcccgtctctccgcacttttaaacagccatatagtaccatcctttgtttaaacagagaacgtctttatcccacaagggtaggtagtccaggaaataccgagatataggaacaataggattacggaatcaaaccttctcaaacagattttccttagtagtctctagagcattcaaaatgcatattctattttatgtctcttttctttctagtagtcagattactgaagattactaagctatcccttttataaatgtgctgcttcgtcagctaaacgcagaccagtttccacctctagccacgggagggcgcacaaatcaagtgacgtttggtataacatgttttaggacctcctggcttgggttgaggaaaaaaacaggggcattgtggtcctctcatgaatgtagagcagcactatccaatggaactttctgcaatgatggaaatttccaatatctgtgttgtccagcacgtcagccactagccacaagtggatatgtggctaaaatgactgaaga

SEQ ID NO: 2669 - DNA, 1300 bp, artificial
  synthetic oligo
ggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggcc

SEQ ID NO: 2670 - DNA, 1400 bp, artificial
  synthetic oligo
atatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagta

SEQ ID NO: 2671 - DNA, 1200 bp, artificial
  synthetic oligo
gtcagggagagatgagggtgggagtgtcaggggccccggggagatggaggagacccctgggcatcttttctgctctgaacagcccagggttcctactaaatggctctgtgccatctgcccgcagaggatcccacagactatcttcctcctccccggtgcactgtcgcccaaatttactggcacgtggacttaggtatgaactagtctgctaggcgggctgcagggaaacgacgaggaaggaagtctgggagacccctgggcgtctttgctgtccgttgacttcgcttttacgacacccaagggctcccaataaatagtcattctatgtcatctcccttccaagggcggtccccttggctccggatcgtccaaatctggcgacggcagaatcatttaggaacgacccaggaggtagacaggggcgctgggttggcgcgacggtcctttggcgcctagtcaggctgcgacgctcgcggcgaaggtgatgtcagcggctctgacttacgtaagaagcttcctaggttgctgccgcagctgcgccggtgcgcagtggcctaggagcgcgcggggcggaggcgctttggaggcatccttccctggggatttccgggcacctctgccccacagcccagctcagcctcccagcggtccctgcccgcccgcgtgttctctccctcttcccctcctcctccgaaaaaccctttgaaccccgtcccgggaattcactgcttttctgcaataacaatagtaataagcgtaatgaataaatgatgtgctcgatcggttttcgcagctataaaagacccggagttgggttaatgactggttgtttaaaagggcaattccggggatgagttctggaaagaattaggactgccgtaggccaagtcgtattttacttttgggacttgaaatgagcgctttaatcctgcctcctttttaccccaaaccacacagcagggacaggcccttcactttcaacagcgcaggtatctggggagtgcggttgtgggagtggtgatttcacttcaaaagaactggagggaagttttgcagactgttgagtggtgcatacatttcccgtgtgtgtgtgtgtgtgtgtgtgtgtgagacacacctctccttaagttagatttcacgcgaatgaaactcactgccagagcagaatgtgcccacttctttctctctttagatgcagca

SEQ ID NO: 2672 - DNA, 1150 bp, artificial
  synthetic oligo
tctggattggttggttcgcatatgaaaggagctctcccaggtgagttgtttgctatctctaggaattacctagccctgggaggtgcagctcctctagggtgaacaaggccccaagatgtcaaagcatcaaaaatacagaattaatgcaaaagccaacactgtcctcagagtggatggcagcagcattagattggagtgatttcccaataagtggtgtgagaggctcccctcttcatttagctccaatggcgagaatgttttacattgcacatattggcagctccgttgtcctcataaaaagaagcatgatagaaagtaaaagctgagacttaatggccaatttaagcttgagataactctgctatggtagatctaaagaggctcccaggttacctacgtagcaccagtctcaaccttatgtgcactaattcaaacttcaggggacacacattttgcatttctacaaactaagcgagtattaggaaaaataaacactcaccagttctttttatgctatcacattctatgttgcacataagaaaaaaatatgctttctagagagttgtaaacattctgcacacaacatccattatgttatagctggcaatggggtccaaatggaataatctgcagactaaaccctttctttatccccagagctgaggctgaggtcagtaggacagtgtgggtgaaacagcttctgaggtgccctccgactctgaaatgtgctgacctggagttttgccagttggcccaggttggataatagactgttagatggcctacatctaagggatgataaaatagcagcccagaccttgatccctgctcctgccaggttctaaagcatcagctctgggtggtgggggtggggttccggatggactgcttttcaattttcccaagccccagaaaagcagtcggctgttacagaccaggattgctttagcctgaaggagaggagaaatgcaacttactgcctttccgatcgtaggtttgtgctgggttgtattgagcaaaaacatggcagcgttttggattctgaacatcagtggcaatttgaaggctgtagagctttctatagggctgagaggatcctggccactgacagccttcctgttgagcagacacatggctggctaaagacttt

SEQ ID NO: 2673 - DNA, 1000 bp, artificial
  synthetic oligo
acacatgatttgatctctgctactttctctcttgcttcctgttttctgtacccacataaggtctgttcctactgttccccttctaaatgtgatccacatcaacacatagccctgctcagctctgtttctggcttcctgtgatccatgcctgcacgtgatctggacatgcagatctttctttcttcctgtgttgcatacccacacaggatctgtcattgcccttcactttctgtcttcctgttccccgtacccatacaggatctggctctgtccatctcctactgtcttcctgagattcacagcaagacacgatctggctctgcccatctctttctttctgtctttctgtattccatatctacacaagatctgtcatttcctctccgttactgtgatcctgtgctccaaaaccacacatgatctggctgtgcccatctctttctgtgctcctgagaactatacccacatataatctggctccatccttcccttctgtcttcctgagaccaacacccacacatggttttgtgctgcccatgtcttactgtattcctgaggatcacacccacataggatctggctctggccacctctttgtctttctaagattcacacccacaaatgatgtggctctggccatctcttgctgtctccctgagatccacatgcacacatgatctggctctgcccatccccttttgtcttcctgtgattcagacaaacccactatgtgtctctgcccgtcttttcctgtgttcctggatacatacccagaaatgatctggttcttcccaactctttctttctgtgttccatacacgtgcatgatctgtcattgcttgtcatgtactgttttcccgtgatacatgatctgtcattgcccttcactcactgtcccccgatccatacacacatgatctggcactgcccatctctttctgtctttgtgatattcatgcaaaaacatgatttggctctgttcatctctttcttttttttt

SEQ ID NO: 2674 - DNA, 1150 bp, artificial
  synthetic oligo
taacagttgcaggtggattatttgcaatattttggaactacttctttcaagcacttatatatactacttacgatagtgtcacccaatatgggttaattaaattaaatgatcagtttgttaaaatagcaccctaaggacctcaactatatcctattttgtcttgctgatgtgggaggtgagttatttgacctggtggtagtgagttgtggaaaactgccttttttatttaatgaggagtaaagtctgctaaaatgacctcttacacttttttccctgctgttaaagttgtcagcttagcagcttttgagtgtggcttttagaggccttggcttccccacccttcagcttgaaatcacctcctcaccattgtgccaagtgctctgggcattccagctaactggaatggtcttgaaaataattgaagaaaaatccgtaattcagactctctgctaattcatcctggcttttgcccctaaagagtctaaattcctgtgggttcattgggcttcagacccaatatttaagactatgacaaagtacatatttttgagttgttgatgcttaaaacctgaaagcagaaagctcttctgagcctcaatttcctcacttgtaaaatgaatctaaatcctttcctgtcctgttgtattaattatgctccttatgaagataatgagtatattgacatattctctcagtgattggcttctccctctctccctgtctctctccttccttccttctctctttttgtttggagtttttaccgttgtaggcctattttttcatgctaaaagtgtgagacttttgcctttcaatctaaacaaacctttgacctcacttcagaatattctactcactgtcaaggacttccgtggttaggacagtacctgttccttctttaaatctttcttttttttccccctctttagagctattcgtttttcctctgccaggatgctcactacccacaaacacagatcttcacaacttgctccaatttcttataatttctgaactgaagccagctgaagccatcttgacaagtctgagcaaatttgaacatgcctggtgactaatcctatttcctaaaaggctgatctttatgctggttggcccaaagcgtttttgaaagagatgacaaatcaagtct

SEQ ID NO: 2675 - DNA, 1000 bp, artificial
  synthetic oligo
atttacaaacaagaagcaaatttcaagttgcaatcacactttgtgatgcttgacaaatgtttaacaacctctttttaaaaaataaatagtctcaaatgggagcctgtaagtaaatacttgtgctgcccaaacatttggggtttgggggagccgaattacaagtcggcccaggaagctatctatgtacaaccttgaggcgcaaaatcgagcaaattcgcctagacccattctccctccggctcttcacacctggatggggcgcaagcacgatacaggtggaaaaagcgagaaaggtaagaaaccatttcgagactgtttctaagtgacggcagcaactttttttcggtcaggccgcgaggccgcctctccgcccctcaggaggcttagagcccctcctcgcctccccgccagccccggacgggacgcgcattccggtcccgctgcaccgctagggtgagccaccggcgcccccagcccccgccaggagcccggcggcgcgcaccttggcaccaggatttgcgcccgcacgccgccacaggcgcatccttccgggccgacgtttccctcccaaactccaaaagttatctcagcccagaccaggcaaagtctacctccttcctccgccccgccacccaccgtgatgccccccaggccccagcccggccctacccacggcagggaggatgcgccggagggcgctgtcggcgctgcaggcgaggggacgggtggaagctatcggccgggcgcccaaaccccgcggcggcgaaaaggccccggggcggcgtgaggggaaacgcgagatcggctgaagggcgtccgcggaaggcgccgggggcgggataccctatcgcgaagccgaactgagatgggacataggcgggatcgtaagggggcgttcctcgcacgggacgcgcgctgatggcttctacccgcccgcccacggacaacggtcggggtccgggacacacctccgcctctccattccttacggggcccggaa

SEQ ID NO: 2676 - DNA, 1600 bp, artificial
  synthetic oligo
cctcaagccccctaggctcaagcagtcctcccacctcagcctctcaagtagctaggactacaggcacacaccaccacacccggctaacttttttattatttgtagagacaaggtctcacaatgttgcccaggctggccttaaactcctgggctcaagtgatcttcctgcctcagcctcccaaagtgctgggattacaggcatgagccacagtgcctgtctataatagtcttgatatctggtagtatgagccccatccccattacctttattctttaacatttttttttttggccctttggcactttgtacagattttaggatcagtttgtgaattctgtaaaatcctctgttggattttgatgggaactgcattaaatttataagctaatctggagaaagttgccaccttcgctatattgagtcttcccatctgtgaaatggtacattttttcaatcattttagtcttctctaatgtctttcagtgaagaatttattatcatccctataatcttgtttaaaaaacgtattccctgatacattatggggttactgttctatttgatgtttcttcaatccttcttgtcctttttccatagagtttagttctattaggatctgattgtgtcttatctagtctgcagttactttatatgtatttttaaaataatctctttctggttatctgtgtgcatttggagtttgtgggggtataattgtatgtttgtactatgtgcagactgttgattgagttggattagtcaccaatgggctttgtaatattctactgtgaactcatcattagcagggtttatttttttgtgtgtgaacattccatgatatttgggatgtgggagcttcaattcaaagaagttttttgtttgcttctgccttgtgccccaggagtatcactgcttgatgaataattctcacggtactttttagtctggagtttctgaactatgtgggtagagtaaaagcaatgtgaattgtggtcttgtggttttgacttctcagagagcttttatttttttcccaccaaaagccctgtgtcctgtggtccctcttgtttttaaatcctttcatttatagaatagttatttgagggtctcagctgtaagcaaagctctctgggcaattccctagctcccagagccccaaagcctcatttcctgcccctgtgtgggcattcattcccaaacccccaggctctgcagacagttgctccccattaactcaggcactcacccttctgctttttcatttccttctttgtttctggcacccggggatttgattttattatttgtgggcctagctctacatttaaaatagttaagttacattttacccagtatttctaagtgattatagtaaaagaattttcaggttgtctgagtccaccatattgctagcagttgataagtagattgtttgtattctttgctgtttgttaataatctttaggcttcatattttttcccagacaatgaccaaatgttcataatatgccatgtgcttgagttatgcaacataaatcatttcctgggtctcaatttttaaaccttagtaggacctacttctaaatttctgtatctttt

SEQ ID NO: 2677 - DNA, 1950 bp, artificial
  synthetic oligo
cagcgcggccggccgaagccgggctgggagctcggggcaggggcaggggccggggagaagcgggggcggcgagctcggccgcccaccccaccgcagccgggggccccgcagcgctcctgggctccaggcactgcgggaccctcagatgcccggcgtccagcccagcgagctcctccttggggaccccaacggaccccaacctccagactcagcggctcacctttagggctcgccccggtacccatatgcccgtttcagtgtcgcacgctgtaatgggtgggagccccgagggcgcacttctaccaagatattcctgaatccggagatcagatgtcagaccacttgagaggggaatttggagagagcagtaaacgagaaatgtcccagtaaaggattcagttcgatggttttcctggtgaaggactggaaatacaccgggttcccagaaaccgggatctcgggcgctctgcctgctgggggtcgaggtggagggggtatataaagtgagttgtccctggtcccctctacctttctgtctcagcatctctcctcctgcatggtcatagaataaaaactagatctggataggacttacagatcccctaagcaatttgtcaaagtaccctattttacagatgggaaaatggaggctcagttctacaatacgaattagttgtagagaccagggaaaaaataagcgctctgaattccctttccggctcattttactgcccccctcccccgccgcctttatagtcgaataacacctgtgtttgcaaaatgctttgtcgttttaaaggcatcgttctctttcgttaaacctgcgggagaatataccatttttcctttacaactagaacaaaattctggattctgaattgcattcacagccctggagacgcgatggttatcaagtgcagatctttaaggcatatcctggctgactctgccattttagacacatgatgggcgagatgtatattctgctttgcaggaggggttgaatttgttttgcaaacaccagtttattaacactcacaacattctaactgaataaatgaatggacagtcttttcagagagacttttaactgattggattaagggagagtagagtcaggaagctcatccaggttacataaattaaaagttttgatgaaggggaaaatggtgtattaaataaacacacccggtattactccaacgggttaaattggttccgtttgaatgaacttaacacgtatttttaacttacatataacttttgcatattaacttctttatttttgctttacatagacctcatacctaaagaattttcatacaccgctagtgggagtgtaaatttttacaagcattttggaaaactctttggcagaatctattaaagctgagagtacaactaccctctgaccagcaattccccttctggatgtacacacaacctcaatcagtgtgtatgtttaccaaaggatatgaactagaatatcataccagtatatttgcaatagcccagattggaaatgacccagatgcccaccaacagaatggatcgcagacattgtgatggtatagtcacaaagcggaatcccagacagcaatgagactgcatgaaccactgctatgcttaatatagatgaacctctgaaacaatgttgagtgaagaagtcaggcccaaaaacacagacactatatgattttgtttctgtaaaggataaaacaggcaaaactaacctatgctgttaggatagcggtcactggagaataagaagggcttacaggtaatgtctggcttcttgatctgggtacagtttaaacggatctatgagcacttttctgtatgtatgtctcacgtcaataacaagttaatatatgtctatctcatattaacagttgcttgaatttctaaagttaagcgtgataccagagtaagtatgcttttcctttaaac

SEQ ID NO: 2678 - DNA, 1000 bp, artificial
  synthetic oligo
tcttacaatgtgtaggctccccatacttcctgctttaaaatattcatgcttcctttcttactgtcctcttgatctcataaattctattatgtttccaaaagagattacttataggctttagaaatatacatgggtcatgacatttgtagccaggatttgacatttagattaattcttattcaaaacatgtctttcaaaattagcatagaagccaaggaaatatagtcaaagaaatgtggttatgcacacatttcagggttttacttcaggcattaagtaggaattggctttggatgtgtaaaatcacaaataaccacagcagagttcttacaagtaagccatcttagaattggatcctccagccccggtcaaaccttcagatgacggcagctgtggctgacattttgacgttaaccttaagagagaccaagggccagaaactcctaactaaactactaaaaagtttctgatctgcagctactgtgagctagtaaatgtttattgttgctttaagttgctaaatgtgaggtagtttgttatgcagtaatagataactgatgaagcctgtaaggtactatgtaatcttgttcaaggatatttctctgattccaccttctactactgttcccactgccccctaacaccagccatggtgatagctttaatatttaaaaaaaaatcccatgagatacataacagaaggatatcaagaaagattcagaactgccatgaaaggactataaatttgaattgaaggtcataaaacaagacctgaccaaatggaaagacacttcaaatattagagaaagagacaacataaaaaacttgattctcagctgggcacagtggctcatgcctgtaatctcagcactttgggaggccaaggtaggaggatggcttgaggccaggagtttaagatcagcttgggcaacatagtgagaccctatcagtagaaaactaaaaaagttagctaggtgtggtggtgcacacctgtagtctc

SEQ ID NO: 2679 - DNA, 1200 bp, artificial
  synthetic oligo
tgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagc

SEQ ID NO: 2680 - DNA, 1750 bp, artificial
  synthetic oligo
acagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatga

SEQ ID NO: 2681 - DNA, 1100 bp, artificial
  synthetic oligo
ctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgc

SEQ ID NO: 2682 - DNA, 1200 bp, artificial
  synthetic oligo
aacaaacccccatgacatgagttttcctatgtaacaaaccttcacatgtacccccaaacctaaaatgctaaaaaaaaaccaaaaaacaccccaaaacaaaaaaatctttacccccaaaaccaaataaaaaccccccttgttttatctaaatcattattaaatgcagtccttccttaaaatttttacattttgttatatttacataacgataaaatcatttcccacttgatataagaacaaaaatctgttaattcattatattattagaataagcaaattaattactgctaacatcaaattcattttaatttccatgaccgtcatatagagttctatacatagagagtggaactccacaatgaaaacgtgcttaactctttttatttcctcctcacagcatgttctgctttaatgacatattgagggaataaaatacatggaattttattctagtatcaagtgagattttaaaatatatgtgaaaatatttgataaatgctttttttcctaatgggtgcacttagaaattatagttttaggtatatttatattttggccatatagtctcttaaataagtaaaacaaagcatactgtaacaaactattttggtcaaaactctaaacagtatatagacttcaaaataacttactcaaaattcatgagatttagatttcatgctcaacttatcaggaggaaacacatccaaaatagaagtgggttgactctataacttctactcaatggctatatctacataactgtgaattaaaacaaacaaaaaacaaaagctagaaaactgaaattggttcttagtcattatgtctagttatgacaaatcgagacactatgagatgattttctcctccggaaaccaggcattcaaagacttccagtgactcaggatgggagtgtacagaagagaaaagaggaacgaagaaagcactgatgcaagaagacacaattcatcaattcataaccacaccctgatctccactaccatagcattacagccatgatctctttcagccttctctctgccactattgccctcagtgctgattttaatagattttacctctttaggatggtagtgatgaggagggatactgaactaccgtgatttgccgtgaattttcctaggaagggccccaggggtctgccatgtaagcgtaacaactcttatgtgagtgtatctcact

SEQ ID NO: 2683 - DNA, 1000 bp, artificial
  synthetic oligo
ccaaattgtctaaaattaatatgtattaattttaaatcagaaaaggtaacaatttattaacgtactggtgaaagctctgatcacaaagtcattggcccaaatgcaaacccaagtcgttggtggaggcaatgctccccagaacttctacaaaaagagaagaaaaatcggggggaggcaacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgt

SEQ ID NO: 2684 - DNA, 1350 bp, artificial
  synthetic oligo
gaattcctttcttcacttctcatattgcccctcattttccctaatttccctcatttttttcatttataatatatatatattttgagacggagtctcgctctgtcacccaggctggagtgcggttggcgcgatctcagctcacggcaagctccgccttccgggttcacgccattctcctgcctcagcctccggagtagctgggactacaggcgcccgccaccacgggcggctaatttttttttttttttgtatttttagtagagacggagtttcaccatattggccaggctggtctcgaattcctgacctcgtgatccacccgcctcagcctcccaaagtgctgggattacaggcgtgagccaccgcgcccggcctcataatatttatttcctaaataagctaacttgatgactacttacaagtattctaaagtgagcttggcttctcagtattcgtcattgtggctttcatattatcttttcacttctctttactatacttttgcataatagctgtctaacaagtttttatggaaataaatttattgcaaacaaaaaaggaaatagctgtttatgataaaatttgtatagaaatgcaaggagaaaaacaaatcactcaactgcttttcaacacgacgaaaagtgggttaaggtctcaaaattctttaaattttaaaataccgatttatcggtaatcgaggtttttttggatctgcttctttaagaaaaaaaaaaacaaaacacacacacacaaaccagcgaacttcagacgctcttacgacacctagctatattcactgggaacgcaatctaacgtcaccaaggcccacctcccgggccctagaaatcgctctctgggaacaagctggggactttgattttgctagccctgcccctctgagcccttcaccaaacttccgcgcgggggcgcccgccccacctcccgccggggctcagcacgcggccttctcccagccaagagccccgtcataggtgggcgccgaccccgagccgatctcgctttattaaattacagaaatcggtattcaaaaaaaaaaaaaaaaaagggcggggaggacactccctcttctctgttcccacaccctagctgattcccaggtttcgggaaactccacaggaaacggaaatggtctctcccaggccagcgcgcgcgccgggttgcatcacccgcctcgcacgggccggcggggcgggggtttggtggctgccctcagtattgcctgcacaaatatctaccaggtctgcgacgaatagctccagcaacttcgcaccgtgttttccactcagcctaccgacaggcactgtgcagattcaagcggagagatgtcca

SEQ ID NO: 2685 - DNA, 1500 bp, artificial
  synthetic oligo
agtacatttacaaagttgtgcaaccatcaccactagttgatcatttttaaagtctcataaattcattaacatatccactatgtttcactccatagcaattttttttgacatccaaattttcttaatgttagacaacctagtaagcttggacactttcttcttttgctttctgctataaggagatgttcctggcttatcttatactttcctgctccagccctggaatcaatcacttctccctttcctttggtgggaaactgtagaggccccaacttggacaccaggggtgctcactgctactgctcattgtttctaggcctctatattgatttttttatctctttagtggagctagtttgtttgctgtgccctgtgatttataatccatgaagaatttggctattattttcaggaattaaacaatgtcttgttcgactaatgactcatgtaaaaagcactgcttgaaaatcacctatttgccagtcattgtttattttaaaattattctccttggggagagtgtgtggcttaagggctcagatgaaaaattcttacttggcattaattatggccaactgaattccaacagaagatgcaacttgctcacgctaagtataacctaagtatcaggtgtcagataaatggttaatttttgtagggcatgcttagttcaataaaactagggcctttctaggggaagataaatattttttaatgtttgggatacaaaaaaaaaaaaagaattaccacaactttattcaagaaggtctacattttctcataagccaataatttattgcttcttatttgaattcccatcagtctccgatgtggagtgaaaatcaacagcttcttttctgactaatctttctctggaaaaatgattgaaaggccttctatcgtttctggctcaaggacctataaacatgtcagagatttttagttaatttattaaaacactgtcaaaaccttgagtaaatgcttttaactatctgatgtacattaacagctctgaaggaacaaatacattttagcacgtaatcaaaattccttttactgctttgaaaccagctattttgtattcatagcattctcttttgaaatgttctgctctcgacctccctagataaaatttccttttattatgtttacttaagtgagaaaatgaaagtacttaggaatgtttttattttgccttacacagcctccttattcgagttccccaagggcaagcacatctttgttacttcctgtgcccagaattctaaaggtccctaatacgaaaacaattatcaaggcaagataggctgcagtaggtcctttaagtgcaagatgtctggtgcttaattaccaaatgctttcaaggatcttaggtgtcctcaaggtcctattgtgagtactttcataaaatgcattttgtattttgtcacatcaaacaatttctgatctctgctgtttacacttccttttcatcttcactttatcatgagtataatacta

SEQ ID NO: 2686 - DNA, 1200 bp, artificial
  synthetic oligo
aactcttcccagggtcaaactccacagccaatcaaaatattccaccttttaacttgagggaaatcgctaaaggaaaggatagctttaactagtgtgtcttttggattgggggactcaaagagaggtctccccaagttccacaagacttcggaccacagaaaacccaccacccatgcgtgtttttgattccttgaggacacatgctgaggtggttgggaacgaagtttcacatctacctaaaagatcatgaccagggatagagagacgaccaaatttgggagagcagttacggtgcagttacggaggcggaaggacgctctcagtaccccgtttccacactttcattcttaaaggcatgcaacccctttctaaataaatgtagctccccaggtttccactacctgaagagaaaccctcacagcacactctggaaatgttttacaattcgttttaaatgcgtattatttctaactaaatcattgagggactcctatgtatttatttatttatttattttgaacattttcaaacggatggggaagttttgcttccatgtttccatttttttccccccaaattggcattaggcaccaaaatcagttgaggaacgaagcattccttagctagaatttaaaacttaacaagggactcttcccgagcttggtaaagagaataccattttaaaattgcactgtaggatttttttaccttcagacaagaacacacctaaaaggaaaaaggccctcccctcctcccgaagcacaaaaacacagcatatcccaagcagcccgtttcctacccagccaatacaataacgctttgtaaactgagagcagcgcccggtatagaagctaagtataaacagctgagaaggattaggcggtagcgctcttctcatttacatgaaaatcctctaagcatcgttttcctcgctggctgcgggcgcataaggaactcttttatgccatagccacgcatacatttccatcctttgtctttacttaccagtcgaggctgtgggcatgtgtgctctatttcctccatggtttctgagggaggctcattggaaagggattttgggatacctgtttctgactcagcatcagtggtaactactggcatggccagtgaatgctccctctagctctacaccctcagagagtctcctcccaggcagagaatgttttctttgtcacgtat

SEQ ID NO: 2687 - DNA, 18750 bp, artificial
  synthetic oligo
ccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctggaaataactgaattttcttgaagcccttacaacctctggtttaaaaaaaaaaagttaaagacgaagcttttacaaatgtaaaaaattcccagttcaaatcgatccataacttacttcttttgcaccgagtgtgtcaatctgaactcatcaatcagaaaaacagaaatcgtgcttctaaagacctgcaggattttaaagttataccaaggccaccaaaacacttactaggtagggcctagaaaggaagaatccaaaaatagtagcgacaacagctcccagagtcccttattttgcgatgtgtcttgctaattgggaagttcaacacgaggctttccctgcccatacaaggctggtatttcagagcgggaggagcagatggaaggggtcctgtgggaagggaggtgtgggtgtccctgtgtttaattaagagttgtattgtgtggaagggaggaggaaagatgccgggctgcacagccctctgttcccttcatcgcaaaataacctgcaagtgaaaaaaaaaaagaaagaaagaaagaaaaagaaaaaaaaaaaaaagcccgctactaagacggagccggctctggaatagataccattagaaccacagtgtttctggaataaagatatctaatttcctgccgcaaatcacttccccgatcagaaaacacaaatagctgaacagaagggggaaaaaatagaggactcctccaaacccggggcagtgctatcctcctcccaaccacccccactctgctcccgactttccagcccacccgggatcccttttgaggacacccagcatctttgagggaagggagacggctcccaggctgaggttgggacagcgacggtggcggagaactggggcactcacggcctaggggcctcgtggggccgctgaggccgggcctgttcggcaccgacggcgtcacctcctcttctaaccggtcaccccgggcagggccctcctcagggcaccgcttgcccgaggcggcctcggtttccctgtctggaaggaggtgcaggagcccgggggcaggggagctccgggcgccctgctggggccgcgctacttgggggcgttgcggcggcggccccgacgccccttgtcaaatcgcctccagggtctcggggacccggtgaacaaagccaagacccgacccccggtggccccaatggcgcgggtgaatgaggacgctggacttaggggcgcccgcgagagggcgcaggctgggagggcctgggaggagaggcgccgggctccgcgtggggctcgtgaccgaggggcccccaggacgcacagactcgatcgcgcctcgaaaatgaccgtggtggtagcaggtgcaggcggagagtggaggcagaaggagtgggaggaggagagcaaatacatctactcagatgctaatgcacagaaagtgagccttagctgttttttctttggagattaaatgaaatctcaaacggatttgtttttgagtaggaaattgtagatttctcacaatcgcatgaaattttgtgttgcacgcctctaatcaacatcacattctttgcccccactttaggctttgcaggtcttagtacagttctggtacccaggaacatctttcccgaaccagaaaattgcactgtggctgtgggagtgtagtaggtacttttatttgggcaaatggcacttgatgtttcatcctcatgaggtgggcgctgattgatcttttcccttatttaaccaggcctcattcttttccctcaattctcccattactgctgttggggccatttcattgttcattactcctacggtttaaggcttgcaagggactaaaaagaaattaaaagcaacgtattttgcttagagaatcccagaaaggctggaaagaaaggcgattgaaacccacggttcaagtgaagtttagacataggagtgatttttacatatttctttttcatggataatagggagttggcgttatctgtcactgtacgttctacctaataaatagctgcaagactataatctaacaggtgtaaaatttcccttttctgacaaatgaagagaccaccaacactatcttaaacagtacaaatagaaaatgctgttgttgacaatctttcacactatggagtcaattctaagctagcttgctttctctttcttttctctttctttctttctttctctctttctttcttcttccttccttcctttcttccttccttccttccttgcttgcttccttccttccttccttcctcatgcaggcctggcttttggggtgtgtaccccacacagagagttataaacaaagataggctgatttaatttctgccctcccccccaacacaacctgcaaaaatatcgaggaggggctttttactctctgccaactgcaaaagggactgatcatcagagaaaatgcctgtcctttctttcactcatttctcttgatctcctccaaaaatatggcctatttagttattaggcatcacagattgggaaaagaaaaagaagcagagagggctgtcccaaggctccattccctaggaggtcccacttccatctggcatatgttgagtcctcctgttttcctctcaaagggagccttgtttatggaggttttctctgcattcatttgttcccagccatctcttcaacagctgtccccccaccttcccaggatcccattggtcaggcttcgctcccactgcatggaatgcaaaaatatctcacccagaaatgtcttgtcaaagacagagagggaaaccg

SEQ ID NO: 2688 - DNA, 1100 bp, artificial
  synthetic oligo
ttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttc

SEQ ID NO: 2689 - DNA, 1050 bp, artificial
  synthetic oligo
tcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctaca

SEQ ID NO: 2690 - DNA, 1900 bp, artificial
  synthetic oligo
cccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggag

SEQ ID NO: 2691 - DNA, 1150 bp, artificial
  synthetic oligo
ttgcaaaaatatgacatcatcaaagagaatgtaactcactctacgtctcacagatgtcactgagttttcctcgaaattttaagttattccatggtacttctgcaagttcactgtgttactccaggacaccttagcacacagcttggggaccagggatttatatcatttcctatatatttgaagctatttgaaatagctatccattatgtacagactgctttgtatgggtctatcactttccacctttcagggagtttttgttgagaagtaggctggatgatgaatttgtttaagtaaatgtaaagggctacatcatcataaaatatttattgagatttcattctatgtaaagggaattgagggaggaaaaagtaattatgtaatcctcaagaagtttagtgtgtttggctacattgtttatacgtatgtgatcagaatatgtcatttcttcattgaactttgttaatatctcccctgtatttctgatatatagtctttcacactttgagttccttttcttatttctgctaatcccttatctctttctgataccattatctttgactccctgctcaccatcctcaagtataatcatctcaccaccactctaataagctctgtgattcccaactccatatctttacccatggtgttttctgtcccatggaataaatttctccccattcttcacatatcacactctcattcatccctctatccaagctcaaatatctgtcttagtgaaatttttccctatccttactcggaccacttttctctttcaggaaaaattacacatcatctcctgtctcatctcataatattcagtatgtatgcctacgtttctctcagtgttctataagagaataattagtaggatggaggaatagatggatgactagatggagatagatagacaatcatacatgggatttctgaaagggatttgacttttcacaatcatcaggagaactgtttaaagagtctgtgtggagcagttatttctgtgtctggtattgaagcttgaagcctgaagaaaagtcattcaaaatatattgggggaggatattaggggaaataagaacaaactggaatacacaaagctgagctagaactcgtggcaacttaccagagcttaggttgatctctc

SEQ ID NO: 2692 - DNA, 1250 bp, artificial
  synthetic oligo
ctatgatccaagtgctaaagaaagtgagaaaagtttctctcccagagaggtagtatggcacagtgattatgagtgtagactcgggattcagaagtagggttttatacatacttctcttgtttaccagctcagtgaccttaaacaagtgaccttggacaaattgcttaacctagccaagcctaaatattgtcatttataaggcagagataatagtgtctatctcataaggttgttatctgtattaaataagataatgcaagcaaattacttagcacatgatgactgattcatagtaagccctcagtaaatgtcaattgaaaaatatagacattggcagtaaggactggacaacagcactaagagttggcttcgttttcaaaaaataagatgtgaccaatgtaggtgtttaaattcattctagtcattgggtgcaaaaaattcttcccaggcagctggaaaaaaaaacttgccaatatgatcatgaaactatttccagtagtctttgaggagtaccctattttagtctgggttccatagaaaagaaatcgtaagacaaatgcttattgctattactttattgaggcatgcaatttcaagaatcaacagtgagagaaaagggtagtgaggcagagagcgaaagcaaatataaaaaattatgtttcctagctggccacagcttcataagctaactacttcatcttgccagatggcttgagaacagtactgcctttagacccaagcaaaacagaatgtttgccttgagccacacatatcacacacatacacacacgcacacgcacacacgcacaacccacaactaaacaacacatgtgtgcctctttccctagagatgtagcactcagtagttctggcacagccacagcaggtgtcgtaaatatccgctttcacaactaatgccatccagatcccagagaaatatctcccatcatctcttgcctatgctctctaaatcctttatgggttgtcccactgccatcattagagatgaagttgagtcctacgtcagactgcagaaagatttgagtggcagaagcacttaggcaagaaaaaaataaagtaatttactggctatatctcttccctcagcctgaatgaaatagatgttagcattacaaaatattattttccagtagtgcctattatttcattcttcacttttatttttttccagttatatatctggagatattcacaaattagcaaattggcacatggccccaggcgaacat

SEQ ID NO: 2693 - DNA, 1050 bp, artificial
  synthetic oligo
ttataaggtcctttgtcactgacctagcagtctcaaatctgttcatcaatattaacttgttatcttctaagtagggtaaaatctcagatccttcatgatgggttgatatccatgttttcagaaattttaaaaacacactgataagtaactcataatgaaaattgtgatatgtttaaaagaaaattataataaaaatactgtatatcaaaacttaaggcacataggaaaagcagtgctttgaaggaagtgttatagccttaaatacttattttagggggaaaagctatgaagtaattagacatctgaaagagaatattagactaaacataaaaaaagcagacgaataataaaaagagtgtaaatcaatgaaataggagtgacgtgcaaaaatgcaacaaagacaaaaattgggcttttgggaaaaaattacaaaataagtatactttcagcaagattcataaagaaaagaaggcagagaaagagaaagagaggaggcaccaaagtaaaaatgataaatgaaaaataaccaaacttagataaagcagagaataaaaagataataagcacacatcaactttaatgcattaggcaaaatggacaaatttctagaaaaatataattagcagaactgatttgagaaacacattataagcttcaatggtcctgttaatattaaataaattaaagcaataatttcaaatctcttttaaagcaaataccaatctcaaaacagataatcttaatctcattcaaatgctttcagagaatataaaaagaaaaaaagggattccttccctaactcatctattaatcctgcatatatctgagatcaaaaatgcataaaagcagtacaaaaaaggagcataacaaacctattttgctcattaatatagacttaaaaaaatagcgtttgcaaaaatcctcaacaaaatactagcaagccaaatccagctgcacatcaaaaagctaatccaccacgattaagtaggcttcatccctggggcacaaggttggttcaacatatgcaaatcaataaatgtgattcatcac

SEQ ID NO: 2694 - DNA, 1300 bp, artificial
  synthetic oligo
ttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgc

SEQ ID NO: 2695 - DNA, 1150 bp, artificial
  synthetic oligo
ctaaggaaagaaaatattcacaccattatccagccccagattcttggcttgagccaagcacctatgtagctcaagccaaggatttctgtgcccagctcgaagaactggtgaagctacaagtgttaacataggtgtcttacatttagatcatagtggacaggacttcaatggttgtgtttttttattattattattattaggttgtattttagacaccataatgccaattttaagtgattttaatgtggagagatgctgaaccatttctgctgaaatgtctcagatatccaatcaacatttattaaggaattgtaccatacaagattcccctatttttcaaccagagaatcagaagcttagggaaaaaaaaaattcccttgttttccaactccatcacttgtagtctaaactattttaagttttatttattttcttgagatggggtgttgctctgttgcccagcctagagtgtagtggcacaatcacggttcactgcagtctcgacctcccagactcaagccatcctccaggattagcctcctcagtagctgggaccacaggcacgtgccaccacacccagctaatttttaaaaaaaattttgtggagatcggggagggctcacgatattgccaaggctggccttgtactcctgggctcaagagatcctcccacctcggcctcccaaaatgctgggactacaggtgtgagccaccacactcagcctaaactcttttatcagcttgctaaaggccatgtaaatagaataggctctagtgacccagttatcttttgaaaagctggtctcctgtaagaaacaaattcggccgctaggtgacgctactttccacagtcgggcttctctgtcttagacatttcttcctatcagcagaagttgctactgtactggtttttggtaatcatagtaaagtgaaagcattgtagtgactgtgggagatgtacagaatgctttcatgataagatcgtaaaaaccagaggcttaactgaatccaacaatctgtttacgctcttgcatctttgattttccttagacttttagctcatcataaaagtcaggtttatagacatttctctataatttaacacttaatacttcaaatatctctgctaattacacatatactctgctaa

SEQ ID NO: 2696 - DNA, 1200 bp, artificial
  synthetic oligo
gatgtaccattatttctatataaagaggagcaacctgtatataagaaccttataaaagatgcaaacctgtatataagaacttagagaagtttcaaatgttgtccaagaacctattatagaggccacgtgatcactgatttttttttcctaaaaataatgtatgcagtatgtgtgtattttagagtttacaaacttttttggcacacattatttctatttgattttcattctcagatgctcgtgagattcttctccaaatatatcatgcctgtcatctatttttgtacttttcattagagagctgaaaagtattatctttagaacatcatccacatcttagaaacaaagggagttgagttggggcttaaatgctgcctctgtaatttgttctggacccaagaaaatttcttatccaggttttggtacagaggcagagagtcaccagtattctcaagcagactttaaaatggttagctaaaatggttaactaagacacttagcataaactcttctccctcacccaagcctctgcattctcactgaagccacattaaagccagatggagccagtagctgtgaggttccttcctggccactagaggccagcaagcctcagttaagaaccttggagtggcgcatgcttttcttactttgtgcgtctagttggttcagtacgaggaaaatgatcctggaatgtttctagaagagacatatggttccaatgtgtaccactgagatgcctctggtttttcagacgtcccaacatttccctgaaaatcagtcttgaacaaattaagcaagtaaagaatgagtgtttttggcgtgtctctgccacatcttccaaaagccccatgcgtcccttttcattctaatgctttttttcttcctttccctgtttgaaagaaacgaacaaaagaatccaattttatgtgatctctttcccacccccacattgtttaatttcctggaagcagtaatatctcactccttcctcatttctcttgaggctaaaagtcctgtctctccctgactttctattgcttgcttctctcttccctctacccactaggttgcgctcgtagaaggagatagagggaggctactgtggccggagagaataaggcagagcatatgggagagggctttgctcagctgagcactgtgctgtacagttctggagttcctatgcctcagcagagg

SEQ ID NO: 2697 - DNA, 1150 bp, artificial
  synthetic oligo
ttgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaata

SEQ ID NO: 2698 - DNA, 1400 bp, artificial
  synthetic oligo
agagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctg

SEQ ID NO: 2699 - DNA, 1150 bp, artificial
  synthetic oligo
ccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcagggg

SEQ ID NO: 2700 - DNA, 1000 bp, artificial
  synthetic oligo
atttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatg

SEQ ID NO: 2701 - DNA, 1050 bp, artificial
  synthetic oligo
gcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccct

SEQ ID NO: 2702 - DNA, 1800 bp, artificial
  synthetic oligo
cattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataag

SEQ ID NO: 2703 - DNA, 1150 bp, artificial
  synthetic oligo
tctctccattggagacagaaagttagatttaaaaaacgcaacagagaatataaaatctatgctcagaccccagataaacaaaactctggggccatattcttaatttaccgggtaccttcacatgtccgaatgcggcgtttatggagctaggaatgttttatttgtttcgtgtatttccctcctctcccccattttcctccggtgtaattcttagaggtggggacaggagagccagagggcttagctgggatcctttgccagagtggcttcttcattctctgcgaggtagcagatgttttactgtagcctgagttgggatcttggaacaaccctctccagcccaggacatgccagcgcttaaggtaactgcagttgttgcatatctatctcgttatcactgactgaatcgaaatgttccggaggcacaattaatgtgaatgccagaatgttgaaacaattcattgaaggacactattgaatgttttattttcaaagtatcgtattccaggaaaattttagaagactattgctggttttattttctctattttcagatatgctccaaagcctattattcccttgcaagacaaccagtgaggacctattctgtttcttataaggatttaacagtgcaaaactacgtgttagtttctcctctaaggttagggacctccttctgttaacctcttttagaaaaatcattttggtggtggtggcggggagatgtttcccctttctctatcattaaatgcaaaatgtttctgtgactattaagtaaatactaattattgttatttttgcttaaaaggagcagaggagagcatctcccagaatgcatgaatttgtggttcatattgataactgattgctttaccatcaaattgtttggtttgatgcaatgttaacaagtggtcttaattcacaacacagaagtattctattccagaaaacaaccctgctgatatgcctgccacccccaccccaaaatgcacacacaaaaccatgtttttgtcttgctttgtgggagagaaaaatggatggggtatcttttctggcagttgattagtccccgatctttcttgaattgtcatttgttttataacctataattatagaaaagaaccctccttgaaataaaattaataaaacc

SEQ ID NO: 2704 - DNA, 1100 bp, artificial
  synthetic oligo
tttcagctgagctatcatcattggttctttctgctccttctgttttactgtgataacctgtaggaacactttcatcatctcccacagttttcttcttgctttccacattttcagcattaatttcctcatccacatcttctagttttagttcctcagttttagaaaattcatgatcctgtgacaaaattgaccatcagagaagagtaagattttcttgttaaaaaacgagggatttgatattgctgtcataaataatttgtgtcatctaaaaaaaccaggaaaatattaattcaaatattgaagccgaagaaaaaaatactgtacagtccatgctgaatatcaagttactgtattaacaaggattttacgcatgccactctatttcaatgactaggatttccaaaattcttactagcacccatggcaaggttacaatggaaaaaaaaaataaatactctttcttggttgtctcacaatgctttcaaccttgagaaaagtttaaaaagcgttctgtctactgtagcattataacataatcatatctatatattatattcattttccaaaatatagggatttagaatcacttcagaagtacgattcactgacagtcatgaggaagataagtataattatttacattccaggaaaaaagataaaggaacatagacagtttaaatggtttgctcatggttattaaaagcagaaggaaaaccaaacagaggcagaacttgttctgtctggctactggccagctaatccaaacgataaaagaggctgtctatggatttgatagactgatagtaaatcatggaatgcttattaagtataggcagaaaatattagtttcagcctttattctacactgagatttcttttttttttttaactttctaattttgggtgaaatactctgattgtcattaagatattaggtttctcattagattcccccccatacttttcatttacacacttcactaaagttataactttatagtttattataattaagtttattataactgcttctaaaatatgtgaagcagttatcagtgccatttactccttcaaataacatttgtacaaagttcaccttg

SEQ ID NO: 2705 - DNA, 1300 bp, artificial
  synthetic oligo
tggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctact

SEQ ID NO: 2706 - DNA, 1150 bp, artificial
  synthetic oligo
ggagctgagcaagatgctaaatcacaaaacctcttcttcttggccacaggaaccaggagatccacctcagacatttcctctcgcccactgttgaattgtaccttctggaattgagaagacatccggaaccatggaggtctggaccctctgagcccttactcctgaacccctctgtctgagcctgttttccttatcacactcagaagggaaggggctgtccaaccctgtttctcatctaagccatccacaagctcacgcttgtagacagaccaccatctcccggcctggcagctgtcagcaacagaaaaacctgctttagccagttccatcttcgccagcagatgtcactacagcctgacctcaggttacccaaaatgagttcctaatttgggtcatgaagctctaggaggaccacggacaaacacgcacccagaagagaatccttttgccctttttcttttcttctatggggcaaacttactgactgccagtaagatgttttttatacttctgtttcaccatctgtaaaatggacatttccaccatgttccctatcttccctacagggatgctgtgggattctggaatgcctatgatgttccagaactaattggttcccctcctcacaggacctcagttatttcctcaaacagaggataaaattagagcacctttatgataattgacttgcctcgcatttgccttaacagatacctggaaccatctccacctacttccgtttccatagtaacagaagggtcaaaaaaaaactaacaaaataagacacctaagaggcataaacaaaatatgtgatggtgtgggaggctgtaaagtttttattgccacctgtttgggaagacctgcataattcagtcgtgctcctggcatttgtgagcaaagcaatcaccccaaagttgtggcaataaagcctttatagccccccatgctggcacgcccgctttctaggtacaaagccccagtttgataaacttccgcttctcacatttgcataatggaaatggactagattttaaacccaggctgttgggaggcataactcgcagctctcctggaagtgaatcacgagctttcctgggtggaggtagctggaagaggcaccgaaccccaccgataagaccacagggcaggg

SEQ ID NO: 2707 - DNA, 1750 bp, artificial
  synthetic oligo
ggaagcccttgacctcaggggccctaaactgcggctgacagcaggcagcaagggggggcccttgggaatggcgctttattgaggaacatttgtcttcatttggggcagtctacatctcatcccacaggcgtgccctgaggcccgagtctccctgacccctaccctgactgtctctgcactgcaacccctgtcccctgcactggattgaaggggaagttgtctcttaaagctccttggagccaaggtgacagacgtcagggaagaataacaggaaattccctcacaccctagaatgctcccagaccctgcccaggaaaagaggcttaagatagggatgggcacctcacagactcagccccaaagacctgggtcctccctggctaagtgattctgctaattcccactcaaattcagcataatagtcataggtttggataatgaaaaaatatgtacctatggttttcagtatgcaaactaaagaattaaatctcctcaaaataattgtggttggtcaggaggcccccagacactgtcttctctctcatagaaagagactctggtggaaaggactctgcgaaggggctttagaacctgaaaatatcagagtgcaagattgtggtgtgtttttcttttcctgaaaaagtcaggatatttaaaatgttagaagaccacgaactatgccctagatgctgccacaaatctgaggagctgttaataaatcatctcacctctctgtgcctcattttccaatttttaaaaaattgcctaatcatcaaagaggcccggaagctaggctaccaaggcgcgacgctgtttacaccccagacccaggttctcagctcggctttgcttgggaaaggctcggaacctgtctgggcctgggggtttagcacagaaggctttggttagctgcactgtgctgagcgcagctctgcagcgaggtttagggagctgcggtgcgttaggcacaaggcacgtggcgcgcctcgctccagcactttgcaaacgcacagcagcgcagggccagagcggctggcccccaggggtgggggcgaccagggacaggaggtcccatatggtgtcgtcgcgttaaaaacgtaggtcctaaggggcgagccgcgtccgacctccgcgcccctgcccgacgcggcgcctcgctcgccggccccgctcgctggattcatttccatctggagcgcggcgcgtcccaaccgcccttatctcgccgccgccgcggctctgcaggcgcgggcgccccgggctccctcccttcctctcccctcccccgcccgcgcctttgtctggcccggcggcgcgctcggagccagcagggcgggtaattggcggccggaggaggcgaacggcccggcccggcctccgctaatgagcgggcggagccgcggggagggcgcggcagggctccggcgcggagccggggagggagcttccgtggccgcgcggaccccgggatggctctccgagtcccggccgccccctcccgggctgtggcggggaccggcgccctgaggggcatcccttcctcctcccctctccctcccctatcccgtccccggcgcgctccaattaccctgcggccgtgccaaggcctgcggctgcccccgggccgcccccgcgtccccggagaaatgccagggacagaacgcgcgggcaggagggcagaaggaggcggctccctgggggcttcgctgcgctgcaggggacccaggcgaccctggggcacggccaccgt

SEQ ID NO: 2708 - DNA, 1050 bp, artificial
  synthetic oligo
gttctttttttttttttttttttttttctgaggcggagtcttgctctgtcacccaggctggagtgcagtggcatgatctcggatctcagctcactgcaacctccgtctcccgggttcaagtgaccctcatgcctcagcctccctagtagctgggactacaggcgtacaccaccacatctggctaatttttgtatttttaatagagttgttggccaggccggtctcgaactccagacttaaggtgatccaccaacctcagcctcccaaagtgctgggattacaggcataagccaccgcgcctggccaaatttctgttctttaaaaatgacccaatctcagatattttgttacagcagcaaaaacaaagatggaaacttgaatggcatttattcttgtttagttttggttttgtttttatcatgggacccttcatttttattttgcagtgggcctctcaagttgtgaagccagctgtgaccatgccacttcccccactgagggatggagtctattcctctgcctcttgaatctagtctggcctatgactactttaaccagtagaattccatagaaaaggactatgtcagttgcacacttcaccttgaagaggactggaggttttcacttcctgcctcttggagccctgagccagcatgaataaagtctaggctactctgctggagagagggacataagggtgtcagacgtgtaagggaagaagccacctcacacacctcagccctagctgccttctaactgcaaccacctgagagaccccaggcaaaaaccacccagccaagctctgttgaccaacagaatcatgagagataataagaaataacaattatgtaatgccactaagcttcaagatgacttgttcagcagtaagagataactagaacagtgtccctccccttttataacctgtgtttttagatttcaaaaagaaaattctagatttatttcttccaggaaatcataatgctaagtagcaaatactatgacgtagtaagagataactagaacagtgtccctccccttttataacct

SEQ ID NO: 2709 - DNA, 1850 bp, artificial
  synthetic oligo
atgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctttgcagaactgcataccccagagcagaggccatgtggagacctgcggcttggtcccgactggtgcagtggcctctgctctggtgtgggctggcggtttccccgcgcccggtgaccttaagggggtttccggagtcgcgcagccagcccttcctcccagcttctccggccaaggccgctctcggccgcccagcctggtcgggctcggctagtcggctcctcgccccgggcaggagtgcggttggtgaaagcactcggggcctcacccacgctctgtgcacacgcgccccgccggggcgggagccggagccgcgctccaacagcccgaaattgccaaatggtcgctgggcagggttggggatagactttgggaaccgggtttgagctggagaagacgaggaaaacgagtgaaacgggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggt

SEQ ID NO: 2710 - DNA, 1100 bp, artificial
  synthetic oligo
ccataagacaccatggaagactgtattttccaaaatggtcacgatcagaccttccatctcacatgctcttcttatagtgggatattggtatccctctcattgaggagtggggcctgtcttccttccccttatctgagtgggtctgtgattacctcagaagtgacactatgtgacttccaaggtggtcataaaaggcaagacagcttccacttggccctcttgggacaatcacccttagaacccagccgccatgcccaggccccacggaaaggccacagccagctagctgaggtctcagctcacagccagcatcaaccaccagatacatgaactcggagccttcagatgattccagcccccagcctttgagccaccccagatgatgccatgtgaaaccatgagaagctgtccctgcaaagccctgcctattacagatttgtgaacaaaacaaatgactgttgtcatttgaagccactgagttctagaatgacttgctatgtcgcaagagatacgcaggacagacacatttatgttatgaaacaacctttggcacgcaccttcaagtcacaatagtgggcaagtcagcccagaggcagtaggagaattcctgaaggctatttctgcactgcaatgtgtgatggttagcatcaattttacatggaagtggttgcaaacccctaaacaaaaactaattgtatcctcactttcatttccccttagccagaacccaaatatgcctgcagctgctcttgcaccatctgacccaatgggaggtgtgttagaggggaagttaaactggaaacagatggtggtctgtacaaaaccttactacccctgagccaagcttggaaggggccagtgtaagtaagggacctgaagcttaagctttattaggttcgcagtaaatccacttctgtagccaatatttactgaatgcttacaagtgctatgtcctgagctaagctctttacatgaacagtcatatgtttttagattatgaccctctgggtaggtattattcttatccctattctacagatgagaaaagagaagcccaatataggtttctgttaaatcatgaataatccaatacatttggc

SEQ ID NO: 2711 - DNA, 1050 bp, artificial
  synthetic oligo
ccagtttttgtgttaccaagaaaaaaaaaacagtattggtttcatagtaggactcaaccagaattggtcctacatatatgtgagtgttcagtttttgcaaataaggtttttgagtgtgataaaacactacagaagtgctaagtgtattgagaatttgctgctgattgtatttataacaattacttgacgtttgcagaaatttagcactttccctccaaatttataggtgtaagagaagcgggggcaaggtgcaccacattttaaaactgcaaatgtgtgaaaatttatttagagattcagattcctaaaaggaaatttcaccacccaagtcatgcacttcttagccttttacaagccaacagactgacatgaagattgttcacagttcctaagatttagcacatatacaaaaataaaactttataaattcaatttcggttttccctttatttattaatacaagatttctaaacaaggtagatgtgtaatagagctgaagggaattttttaaagggaaatgtttatgaggaattcagccatcattgtgtatatccaaagtggattcacacctaaggacctcaaagaaatgagttgtgatctaattgcagactttagagttaaaactaagattcagcaaactgtggtgtttcagttctcttaaactggaaataaagcagaccacatgttttgaggggagccacagaagtgaaagttaactctctagcaagttccatctgctgttttttagtgtctagaaatagctctttgttgtcatgtcccagggaaattaagatttcctcagaaacctggaggtgctttcctaaagttgggttacttcaagaactgctaaaagacaaatctcagattttcactggatttaatttcactgatttttttaaatagaaaactaatatttaacttttctgcaatttggaaaactccctccagttggattagactgtattttaagtatttttagctacatgagtacatctaactgaaaatctacatcaccaccaatattttgaattgtttcttgtaatctggtaa

SEQ ID NO: 2712 - DNA, 1750 bp, artificial
  synthetic oligo
caatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggccaggtgtgatgattacatagtcctatagtgctagtttacttggaagctgaggggcaggaagattgcttgagcccacgagttcaagtccagcctgggcaacgtatagcaagaccttatctctgaaaacaggtaataagacatctatgcttactgtacacactgctgcaataggctgctaccacaagtgtataggtgcttggttagattgagccatactagcggtttgatacgtttcaatctaacaaatacgtattcagcttttgtttcagtaagttgaaggtttgcagtatgattaagaattttttgcattgtaaggaagtatggttctggataatctttccagtcatgaactcaaaataagcataagtttttagggcagaattttgacacatggccatatgtattttgaagatagaaaagatgatggtacttgagtctcgatttagtcaaaataagcatggaaaggtttgggattgctagattggatagtcaatggctgaaagtgactcatggagtgaaacgatgctaaggagagttcagtttccactttatgtgaatgatgagtgaacatgacaatctgctctggaggaactgccaaaatttgaggttatttctagtctagcatggttaggattatggtgacataaatttagtatgtttacatactacattaatgtggtttaattttaattacacttaaatgcagttgtcactcttgggcactgttgatgtgtttcctggattcttggctgaatttcaagatttttaaaatggctttataggagctgtgtctaaccttcatgcttaaaatgtttcctttgctcctatgctctacgtgacctgcttgagtggccacaggcttgctctttagagcacagtgactttgttgatagggcctcactactcccacaatgcagagatacctacttattgtaggtacagggcattgaaagttataagactatctttgggttttgctttcttgtgttccattctatttttaatacaattctgagtatatttaaacctgctttgcttcatgtcctcatttcagtttatgatctatttttcagcatgtttagtgtcattgtttctaatgtggctg

SEQ ID NO: 2713 - DNA, 2200 bp, artificial
  synthetic oligo
aaagtcttcgaagaggaacctctgctttactttttacaaaagctgataacttttctgtgttattataaatttacaaacttcagactgtattttctgctgtttttaaaagtaattcttgagagaaacgctcccattgcttgctgagaaaccagctcttcagaacaaggagaggtttttcttcacactctgattaagggtgggacacccacgatcagagctgcttgtggcaggcggtgagggcctgagaacagtgtgactggaaacaaggctgtggccagacaccacttcctggagagggcagggggctcagtgagccttgaacaaaccatagctttgagtaactgcactgtgtctcactcctcctaaagataaccactggcttgggtgtatgttgaactggacaaggcttacttaccactgcccctgatttaaagaaataattatcttttgaatatgatattctaatgtgtactaaattagtcatgtcttctctttctgcataccagcctcccaatgccctgagctcctgattggttagtgagagtacttaagaggccagttgcagccagtttaaacactagtttggatagcctaaaataatttctagatgaagcacatggcttcaggaatgactaagctgtcctgtgtcctctgggttctggctctgagggaaattgataagggaccctaattctaaccccaacaatccatgtgagtcaggaaagctctcatgtccccttgctatgtatagcccaccatggattgccaaaataaatgtccacatgcctgccctttgatgatggtatctcctctgccaggtaagtatatgcctgccctttgaaacactctcactgaaccactccagatgaattttggggccagattaaaaaacacacttgatacacaaatccatctcaaaagcaggaaaattaatacaagacagaacttcaattgtaggacataactctaacacctcaaggaagtaaatcctaagggtgacagcagaacacttaggagatcaatatttggcagatgatacaggaatcaactagaactgttaggccaagagcatttggacttggacaatagaaggggaaccttgaagagacggatgggcaagatgaatgagaaccaaagaaaactattggtgatttgaatgagaaaagtccaaaggggccacttttacagaatacttgtaacatactttattaatctagtattccctgacatttactctttttaccaattgtaacaatatttcctaatttcttagaagaatgaaaataaaatttacatatatttcaattggggaactcaaaatcactgaatcctaaagaatttatactgccattgttggaataatagtttgcttaacaaagtccagagttttcaaagacagaaaaaaactggacttgatttcttccatggtcagtttctgctacctcaagtctagaacaggatacacaaatacataaatcagaacaggaaaccctatctgaacaaagttaaaaatacttaaaacatgaccctattgtgagtaccataaggtacccttattgacctgctagaacaaccaataatttctttctaaggcagagaatgaggtcattttaaagctaatttactaattgtattcctctaggcaagctatttaacctctttgagcctcaatttcctcccgtgtaaaatgggactcccaccacacatctctagggttcttagtcataaaatgctctgtcccatacctggcacaaaactgtcacttactaggttatgttctcctctctttccttccatttgctttcacaaagcctttcagaaccactttgagtcactgtttctgcccttctctaattcacagagcatttgaaatctgtatcacatattaatctaaattcttggcttgcttgtggaatctgctcaatttccagagaccctcaattagcttgtgactaaacatcctacttctgtgacctccacatgctgctaggaacatagtagaaactccaataagtatttgttgaatgaattacactgtttaacaaaaatagacctaaaaaccaaaatagtgtaagaactggcaaaacttacacctatccaggtatgcttgtccaataaacaaccagtggactgacaacggtttttaagcagtacttctgactcttcctttgtttcaacggttgattgacatctgtgatag

SEQ ID NO: 2714 - DNA, 1050 bp, artificial
  synthetic oligo
ctattattaaagcttccaacttatgttttgaaattcccttagagaatgtttgaattccagaatttctatttgtttttttctaaatctagctgtctcatctttcacacccttaataatttgtctggtttctttgcattgtatttcaacatactcttggatctcgttgagtttccttgcaatccgtattttgaattctttgtctgttatttcagacttttccattttttagaatcctttgctagagacctagtgtgattttttggaggtgtcaagacactctggctttttgtactgccagaggtgtttcactgattccttctcatctgagggagctgttgcatcttatatttgaaattgctattgtttgaaggagactttttttattttttattctttttttccttgagggtattactgtgacatatgttatgtgtgatcatttggctttgtttctgggtgcttgcaaggggccaaggctctgtatgggttccttggttgtgggtagcttctgtgtgatggctttctcagatgctgcttgttacagtgatgtactggatgtatgagccaacatactatctcctgtgggatgagggtccataggtctcaggaagcttatcttatggactaacactaagcctttctggcagcaggttttctatttggtggtgcagttcagactgcagtccagtaggtggcacttaagagtaagagcttgccccactttaggtaggctggcgaggagtggaagcactcaccctgatggggaggtggcaagaagactaaagtatactgaggtttcagggaaaatgggggtgaaccagcttctcatcctgagccaccaggaatgcaatcttattccctatcatgcctggcacaggacccatgaccttcagttcatatacactttgtcctttggttcccagctacaatgcatctatggaccatggatatacctctctgactgctaccaccaaaatgggctcagggcagagcctcttccctggatctagggaaggtaactctgcatcttgtctgtcttccattgctgag

SEQ ID NO: 2715 - DNA, 3150 bp, artificial
  synthetic oligo
ttctatttctttaagaataaatacttatgcaaaagtcttgagagctgctagtctgagaaaactgatctcaaaagttatccaagtatacaagagggggaaaaaacaattaatatatctcactagattcatctccctcccccaccctcatcccactccactgctaagagagagaaatttcagcactgctatcctgttttattatacattttcccttttgagttaaggattttaagattttgaaagtaacagaacaggaaccaaaagtagattcaacttccaatttggcttaaaaagaaagaaataattattatttcctatattacccaaaacttattctgttaataacagttataattatatattcaaattaataaatgaagattgctaaaattgcctatatacttgttagcagttaaagaagaaaaattttttccatttgcttctataagtagacatcacatgattacttctattgaccaataagaaactagtaaaatcaggcagtcacccaccattcttttctaatgttctttttcttattctattcaaccttttcagtatattcttaagaagccaaatcaagaaattagacattcatgcctaaaataaaattgcgttaccttatacatcatgaacaggaacctgttgtatataacacgggtattcaaagctttattgtctttttctagaaccctttaacataaaggcagctcagattcaagattagaaaactgaattcaacaggcaggaacacgcatacgaaaccagtaagaactactaatcacgacctctcaaaatgtcatgaaccatatagatagaaataaccccccttttgctgtactaatgtaatccaatagaacaaacttaaaattcgtgacacaaatgtaagaaacaaaaaacaaaaatctattgccattgtaatctacccttcccaatcaggagaggtgtttccgacgcattacttgaactttcattttgtacaactttcatcttgtaaggttctaactaaatacttgacatcttaatgcagaggaaaggaaaggagggcaagtagactaattctgaaagcatcccttcaaatttcatacatgctattcagactaaatggaaatctacatccatggaaagttaatgtcgcaattctactaaacagcccattctgattttatgtttctcctccactaacaagaaaaaataaaacaaccaaatctagctgtattacatatgtttagctaaactgatagcactcagctcatttttgttaattacctggcttcttctcagtctttatgcggtattctcgtgctgctcttttttagaactcctcactgtttatgtgttctctgttcaacacagttgttaggggtctgtgaacaatttttcaattcccacacacgcatatgatatctattagggagcaatgccacttttcacttaccaattctggataaaggagtatttcctggtgacagaatgctgctgcttccgttcactaaaactccctcttcgcagcttgataaatctgattataaaacgtctttgttccagatcacacgaggcgcttttcctacaaaagttttctaaagagttatctgcatttcattcctgtgacaaaacaaatcagaacaaggggggtgggggggggaacagggaataagtccacacaagttcctggcaaagattttaagctgcatttttctgagtttaatcagtaacctatattaaagtgacagttaccagttcaggaagcctagagtttgatcaagtcggtcacaaccactttgagagtcttccactggtgtgcggactccaagaaagcagtcacttggtcatctatcacatgtggctgaatcactggacagaccacccccgccccacacacccccagcccccgttgagcagcagcccaggcaggagagtggccggacgcccgacccaagacctcttatagggacccgccaattagctgctgaccaatcgcagccagcacctagtacctaagtcacatgatagggcagtccctatgactgcaggatttctgaattactggggttacacaaaggacactcattcaggaaaagagaaaaaaagccataagccgaaacagaaaacgcccaggctgcgacaactacggctttaaaacagggaacaccccagcctcacacagacagagaaagagccacaaccaagccaggatgaaaatcagaagaatgtctggcacatattaaaaaataatcccaaagcagacgctgagtttacaaacccacttcagctataaatctactcctccttccccttcctctatagtctccaataattttacattctaaacttttttattttaaaaagctccagtgagcctctgcaaaaccgctgtaagaaaatgtgcgagacacatgagcctctcttcccatcccctcaaaatacccctgaaggagattcaaattggccatgaaaagattcctaagtgaaatacatttcttttaaaatagttaaataaattaagtgaaattaaacattgccagaacagattcgtatggtaactaacaaatcatctctctctcaatcattttaaactgtacacatcaaggacactcttgttaagtaaacgagcccactttgtgaactagatacccatttatttttatttgaatgcccccaatttgtctcttaaacaccttttatgtttaggaagaaattcaactgcgaacacccctaccattgctccgacctccaaaaatggtacttacaaatgttccttgtttggatctgtcgacttcttctcccctcccccgacatttggagtcaaaatatgggctcaacctcatccttcaaacctaaaggccctattttgatcgtgcaagactgcaacagctccttctcccaggcaagcccagaacactgtgccgcttgccattcccaatttatggaaggaagtgtatgtcaaacaaaccaggtgatgactcagactgcctcctccagccacgttttccctagaatgggagggtagtttaagtgcagcccatttggatgtgactcagttttattagactggtggctgtagctaagctgacaagctcacattttttttaaataacttgtacatttagagatcaggacgcacattccaactggtttcaagaattgaat

SEQ ID NO: 2716 - DNA, 2450 bp, artificial
  synthetic oligo
ccacatggtcacaatggaaaaacaactcttttagaacagtaaaaagtcatgtaatataatgacatgcagaatttttatttaaatacattgtcagaaatagattagaccctgcttctcctcggaggttacctcaaaatacatttcacttcatagaaatttatataagtgtcaaaatattgaacataagagcaaatgggttagtactactggaatgcaataattataaagctagataggtggattaattgtcctacatacctgtggtttttcagattcctgtgcttgcttactcatgtacatttgactctttcagaaaccacttctggaagctcccggtctggcttctacactgccacctgtagacataaaagagaaataaatcatgtattattcgtcaacaatgcatcttttctaggcatctaacggggacatctggggaaaaagtggcaaaacatttgctccaaaagacaaaaatgttctttctcctctgtgttgaaaattcctaaggcgtccttctccccaatggtatgataaattatttgattagaaattgaaacatatgtaagtctcagatcatcaactatacaccactctgagccgatcattaaagagatggagtcgcagaactcaacttacagccatttcaagacctgtcgtttaaaattaaaagaaaacttcaccgctttgttcatctgtaattcagaattctgtaaattgacacaaagaaagatcaggggcgattcaggctaaggttactttaccacaaggttgtaagatgtctatttaaaataacagtaattctaacctgaactacagttttgtccaatccaaacagcagtttggtggggtattttcatcaaaatgccctatccttgatttgaatatgaatgactgcggaagggtctttctgaaaccccacggattttaatacaggtaggtcctttttccaaaaaaaaaaaaaaaaaagtcaggaaatgaacaaacaggaataaaaattcatgaacaactatcggcaaatccaagcagccatgagacgtgcgagtgtgtgtgtgtgtgtgtgtgtgtgtgtgtgtgtgtgtgtgagagagagagagagagacagagacagagagagagagagagagacagagacagagagagaccgaccgacagacacacactgagatttctggagttaattgcgaataaccgcgccgcgaagcttttttacctcctccaagtcccacagtctacctaggacaagtaagcccggctccagcaccttaagccaaagacacaagcaccaccacctccacccccactacctaggcgagacagcgccaaaagccaccgagcgtgcacgccagccaggcccgctaccccgcaaacccgggagcttctttatccccagcagagatccgccccacttaccagtaatttactttaacgcctcgaaagcatgatttggtttacggaattgcagcaaataaaagaaaatcaagtctccttgagacactgtcctcctcctccctaggacgcacattcacacggaacactctcctttcgctctcaaccccgaacacgctctggactatcccaagagggtctttggggacccgccagagatcgatactgctcccacgtgcctccattaaacccttgtccaaacatgcacaaggcgccaagggcatgtgcagtatcagccctcagagtaagttcagcaaacccattccctacccccgaaagcgcgagggagcaccctgacgcaagcgccggccccggcagacaatactcaagcaactccagccttccgcgcacacgccccgaccggtccagccaccactctctcctcccatggtccctacagtcttcgggccgggagcagggggcgtcctgatggttgctgggtgtggactgtgaagagaagggcaacctgcacacgccaccgatactgcggggcgggtaggagatcgcagttttccaaagccccaccggtgtgcccagctcctcagaaggggtggggtggggacagtggaaccgagggagtgaaccctaagggaggcagcttttctgcacctctttcccacctaccacagcgcgcgcgcagaagcgcgcccaccacggggccgtgcaccttccttctgcccctggacctacccagccctcgcccccaagcgcagtggcctggaagagcgggcgtccggcccgcggtggccgggggagccggcagagcgccgcgctcgggggtgcccacctgcgcgcagggtcgtcgctgctgccggtgcacccgccgctgttgcagtctccagctgcaggaggaagaggcgcggcggctgagcccccggactccacgcgcctactcgcgccccggagcggtggtcctcatttcccttcgtcccggctggcgagccacccacctcgcccgcaggttctgccagtcccgcggcccgccagagcccaagctatcctct

SEQ ID NO: 2717 - DNA, 1100 bp, artificial
  synthetic oligo
agctacttaacagctcatcagggcctctatcagtagcctggagaagtaaagaatgagtcagtgctgatcatatcgaggtcacaggggtcaaaatgccaaactgaatttcagggggtttctgaatcaatttagaataagaacctgggttacagaaatgattcatggccatcacaccacaagccacaagccagaaaaattaatctgttttattaccttatttcagagggaatttcttttgatgtaatctctgtaaatgtcagtttctacacttatgtaatcattatttatacacatctggaaaaatgcaacgagctgacacatatatatttttcagtaatggcattatgctgtctggatagagtcagacagaaggaaggaaattgataaagatagaaatcaattaaaatgaaattagaaaaacaatacagaaaatcaatgaaataaatagctggttctttagaaaagatcaataaaattggcaaatgtctagcaagaccgaccaaaaacagagaagatatatcaaaaatggaatatcactatagaccccacagacatcaaaaggataacaagggaatgctacaaacaacataaacttgacaacttaaatgaaactgaccaatttcacaaattaccacaacttacccaatatgaaataggtcatctgaaaagccctataactaataaagaaattggcttcataattgaaaaactcccaaaaaagaagtctccaggcccagatggtttcactggagaattctaccaaaagtttaagaaaaataattaacaccaattctacacaatctcttccagaaaaaaaaagagtcaggaacatgtccaactcattttgtgaggccagattactctgataccaaaaacagacaaaagcagtacaaaaaaaaactactaccaatatccctcatgaatacagacataaaaatccttaacaaaatgtttgctcatataattcagcaatatgtaaaagaataatataccacatcaagtggggtttatttcagagaaacaaggctggttcaatatttgaaaagtaatcaatgtaattcactatattaataggctaaacaagaaaaatcatatgatca

SEQ ID NO: 2718 - DNA, 1450 bp, artificial
  synthetic oligo
aagtgatccacctgcctcggcctcccaaagtgctgggattacaggtgtgagccaccgtgcccggccaggactgtcttctgagaagtaactatatcacttctgtggtcaagactcaggggacccagagccatctctggagcttgtggccaggtgtaaacccacaactcaacattttaatatagatgaatagatacatcaagctgaacaggaagggcagccttctatagaaaagaaatcactagaatataaatagcaggaggagcacaagcagaacaagcaaccaacttctgcctgaactcttcagagttagcgttcccttttcaggacctgcttcccacccatatctgtaacacccatgtttggaattcgcccctgcagctgcagcaatgggaccaggggtgcataccaacctagagccaatctgttattgactggccagcaatgtatatgattatctcccttgagagtctgagactgtagcatgcccttggacagaaaggccatgaggaatcagggtgggatagctgttgtcaaccatgtaaatgctgatgagtaagtagagagctggtttgcaaaaataagtagtgatgagaattcatggggacaggtgaaaaagagatggggcagaaaagaaagaaagaataagagagaaagaaaaaggatgagacagcactagtattagctctgttcattagctttctagtccccagttcttaacatttgatttaattttctttttgtaattttgtttttggtcaagagtgatggtaggatgggaatgaacagaaaagggactttatcttcacttttaagggtccctgaaaagatcactcttggatataggttttattgtagatttgagcttttctcattaatgaatacttcaaaacagtgagagtttcagaggttgtttctctagaattagttttgttatattgtttgttcattaagaggaatagcatcactgtgggacagagctcccataggcatcagaaggccgaggcagatacttatttcagatgaattagagaggaacaaacttaaggcaggaggaggcactgggaaacacaggatgtggatttttccagtccctgctcagccactctcatcgtgaccacagattcatcccttcacctctctggatctctgcctcctctgctacactaagtagtggtcatagttatatatttatatctggtcacagatgttttataatcatagaccatagattataaatataataatagattataaaatatcgaatgagggtcttatccaaaaacatcttcacataaaactttcatctcactctgaaggagaaaaagtgtgcactgggtaaagactctattgcctaagatctggaacttaaatttgcagtaatttctaatacttaagcacatgtacttttcttcccgattgtgcaataaaggacgggaagtaaaaaggggaa

SEQ ID NO: 2719 - DNA, 2100 bp, artificial
  synthetic oligo
gaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggt

SEQ ID NO: 2720 - DNA, 1700 bp, artificial
  synthetic oligo
tccaaaaaaaaaaaaaaaattagtttatattaggttgaaccatatgaaactgccattgttgcaagtcaaaatgtttgcatatcagcaatttcatagggttcaatctaatactgcaggatttggctcatgaacaaaaataagcaaaaaataaaagcttccttcctttgcttctcttagtctccaaagccctcacatattctagagaagtttaattcctatgaacttttaaggacatatattaagaaatacataaagcctcgcttataaatacatttttttttctcaattcaaaacacctagtttcctttaggagttgtattccacttaccagacttaaggtaattagcctgtgggtccccagtggagtattaggtctctctacctacatctcaaatttctagatcagatctgagcaccctcttttcatgtgccatttgtacacggcgaaccaggattccagaatgttgtttaacacaagaggaggttgttgacaaaaaagtattctgattattactatcagtgtgtgcttggtgtcagtggggggaggatatatttgattttattctagtttctgctttttctgccccagagttgcaaccagatggctagactatcatctctgggtctcttgtcagtcagagcaggagaagcctaagaggcaggattcctacccctgcatatgtgactagagtggtgaggcagttttcctccatcttcctgggcagccacaacaagaccctgtgaggaggcgcaggtgcttcgaataactggcactctcccaggccacagccgaagccacatgctcagaacagaggctcaattttaatccttctgagacaccatttcagggattggccaatatacaaacatgtaatcaatgtaatgcttttgtgtgctcgtgtgggtcttgagcttgtgaattttttgcattaacggttttagaattttctgcctagaaatttttagaattacccaagtataaacgcagtcttttttatggtaaatgttatttcatgagaaacactgcatacataatttcagcttcaatggtcagaagatcctgtgctttcaagcttactgttagaaatgcaaaacagggacaccaaaactccatcatcccacctcagttccctcagtacaggatgtttccctccttcaaaggttttttataagatctttcgtccagtgtattttacataaccagctttctctatttcccaaagaaaattattgcacagtctaattaagttttcccttaggaaacaccactcctgacacacaaaggaagacaaaacaatggtggcagactgtggaaacagaaatatttcatttttaccagctgaaaaactataaaaattaaaactacccctaagctattaatatgcaacgatttgaaatatcagcaattcacaggagactggtaaaaagtcctttgttcatttactgtttttatcaagttctgaattcagaaccccacataactactttgacaactgatagcatcacaaccacctaaaaacaagttcagagcgttccgttgtagacagtataaatgatgcttgtttttgcatgatctgtctcagaagtacagccaaggaggaactaagtctcacatgttcactctcacagggcccatcaaagaactcaataaagatctgatgaaggaacttaggctggaatttggaaaatgtggataacac

SEQ ID NO: 2721 - DNA, 1500 bp, artificial
  synthetic oligo
accagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatcatgctttaggtatcaagtctgagaactctttgcttagccctagatcctgaagactttctcttatgctttttgtaaatattttataattttacatttttcatttaagtctgtgatccattttgagttacattttgtatattaggttgtggtaggcagagatgtccgtgtcctaatctctgcaacctatgaatatgttaagattgctatttagctgactataaaatagggacattatcctggattatctgggtgggtccaatgtaattacatgggttcttaaaagtggaagagggaagcagaacagaagggtcagagaatgagatgcgatgacagaaacaggatcagagagattcagtgttgtttgccttgaagatggaagaagacagccgagatcaagggagtaagagtgtcctctaaaagctgtaataggcaaggaaatgagttctcccctgtagcctctagaaaggaacgcagtcctgatgacatcttgattttagctcggtgagacctgtgtcaaaatcctgacccactaaactataagatagtaaatttatgtagttttaagccactgagtttgtgataatttgttactgtaacgttagaaaactaataggtgttttagaaaagcttctattaaaataggattttatacatttgggtatactgtgtatctgaacaatttttatatatgcaacatccccatgatatcagataaatgaagtgctactctaagtagatctgtgcattcagtggggaatagttagaaaatgtattacttttatttctgcttaaatttctacattcattgtgactttaaattccccactactactttttaataggaagtgtcttgttgttactgttggttttgtttgcgtttcagaagagatttgaatgaaattttgcaccagagagccaaatgtagccccaaaaatttatgtgatgggaggctcttttttaaaaatattcaattgactttgactataggacaaacagaaccttagttaatggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattgga

SEQ ID NO: 2722 - DNA, 1100 bp, artificial
  synthetic oligo
gacatatgtaccttctattactataatcaagatggtgaacttacccattaatcccaaaagatttcttgtgccctttgtattgccacccagttttctctgtccccctccctctggtaaccattaattagcttctgtcactatagattagtttttgcacctgtttttaatttacaaagctgattggtggtgaagtttctcttttaccaggggaccaccctcagcccaattgctcttttcttatgagcagaacatttttagagattttctttttgcctctaggtcaaaattactcaagagaaaacaaagaatccagccaccgccatctctgcaaagggagttttagtaaccagctcaccagattcccaagtatatgtttccagacctccaaaaaaggcaacagcatttcactcctgtttgagttggtaaattcaagtccttgcatttaaggagttataggctacagtgtaagaaaagccttaggattcttcccttacagtggagaagggttgagaagtcaccagggttcttctcactgtctttgcttaggtaccagcaagggctattaagcaacccaatgttttcccattgtccttcacatgaatgattataaactcccagcacagtctgagggactcagggtggtccagtttctacagagacccaggaattgaatccccaaactatacacatgctattacttctttcactcttcaagaggaaaatgatatggcaactccagcaggcttagctgttatcaactagaactgatcctaagagcaatgatttattgcttgcctaccatatatcaagcactgggctaggtggtatagaattgttaatctcatttataatacaaccaatccacaaagttggtacaattttttcccattgtacacaagggaaagctgaggtaaaaggaggtgaaaggacttgtcccagatcatattcatagtgactagcacaggagaaactgaaactcagatctgacacttaggttaccctctatccactgtactataatgtcagattgctaagcttagggatttccctccacatcccaaaagcctctcataagaggagaattccaactatatggcttt

SEQ ID NO: 2723 - DNA, 3500 bp, artificial
  synthetic oligo
tccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcgggaccgccccggccgccggcccgccccccgcccctgcccccacccggctcgcccggcccgcccccgcgcgccccacctgcggctgccacccgcacccgcagctggactggccccaaggcaccggcgcccggccagggccagccccatgacagcccgcaagagatctctccattccacccgtccctgggtcctcacttaacggagcctaaagaagccctccttcccagagtccgcccgtccctcgggttcgccaggttggggatcttcatccaaagccatcccgggaggaacccccatcccaggcagtccccaggtcccgacaacccgtggactccccatgccctaggtctgccaatcccaagcagtgtcagattccccttcctagccagcccctgtgtcttctacctcaggcgacctccctccagcccccatcatgggcagtcgtccctgagtctcccatcctggccagtcccttgactgtctgcagctgccctcatcccaggcatcccttgggactcccaaaggatgcgcacacacacactcatgtacaacatcgcaggcatctcccactccagccagcccttacactctccattcaaaccagtgcccagatctcctaccccagccaaccccagaatcccccatctcagccagtccccgggtcctctaaccaaggcagtccaggatctctcaactcaacaagccctgggactccacatcacagccagtcttgggatcaaggctccattcattcaaccaaccctcatttcctgctctcttttagaaatgctctccccattcactccatcatccccatccactgaaactgtacccatccttcaagacttaactcaaatgccaccttactgaagccaaccctgatttcctcagccagaagtgcaagttgctgctctctctctctctctctctcccctcttgacctcctgctgcactccctatcttgtggaatttgtggaacaagtggaacttgctttacagcacattcgtctgtgttcttgttttatgtcctctgccagacggagctccttaaagacagaaacgtgtcttaatttatctttgtgagcaggttgggttagaggagaaaacatgagttttacagtcagacaaaactggatttaaattccatcttctctcttaatttcaatttccctatcaataacagctacctgacagggtggtcttggataaaagcatgcaaaaaacaccttgcacagaaaagacaacccacagaatgagagaaagtatttgcaaatcatgtatctgataagggacttgtacgtagaatatataaagaactcttacagcaacaaaaagacaactatttttttttaatgggcaaggaatttgaataaacatttctccaaagaagatatacaaatggtcaataagcacatgaaaagatgctcaacatcattaaccatcagggaaatgcaaatcaaaaccacaatgagctctcagtgctacccatcaggcgtttcctgcattctcccataacctaaagggaaacttccacaatgtctggagcccttaatgtcctgcagatgaaggaagagatatcctcaaattccttgcagcagaaccccacttgaatggcaccaaccttgacttccaaatggaacagtacattacagaaggaaaagtggtggcatctacatcataaatctgaaaaggacctggaagaagattctgccattgttgccattgaaaaccagactgatgctagtattatatcttccaggaatactggccagtgggctgtgctaaagtttgctgtttccactggggccactcttattgctgggcacttcactcctggaactttcactaatcagatccaggcagccttccaggagccacgtctgctggtggttactgatcccagggctgaccactaacctctcacagaggcatcttat

SEQ ID NO: 2724 - DNA, 1100 bp, artificial
  synthetic oligo
tgcggtctggtgttccagagtcttaagattgcagactttagagggcagaaaggtaggaaagtaaccatctgtgaggaacatagaagaaaaaagaaaaggaaaaggaagattctcttctctgtggggatccctaaagagatagcggtgcttaaaactgagacggcatttggctaattaattaattatccttccagccccctttcccctagtgggggaaggggtgagatgtaaccaaaatacctatcagtctcaaacagctgcacagaaagcaattctaataggcaagtctggggtttcgttttaggaaaattttctctctgaagatgatttgtaagcttgatcctgtcagaacataaaaccacataacccaatgtgtttccaattttgtcctagctgccataaaactttgagccaaattcagagtccaattataatccagttcattttaggtacctggcaacatctattcgtgcttcctttacatggtatctggtctgttttcttccacatttttatccctaattgtctttctttcatgttataaactgatgagtcgcctaatatcctctttaaagtaggcgggatataaatcttacataaactaaattatatttacagatgctaaggggatttgaaacaatgaagaacatttgaaggaacagatgatatttggcctagaggagagcaggcttatgaggacatgattactgtcttcaaatatccaataggctgtcaggggggcaatgtagtggaattattctgcttagctccaaagggcacagccagaagcaatgggtgaaaattacagagagatgatcccagagggaagaaagctctcacaggcgatgcttggcgaagatggcgagttcactgtcattggaggtcttcaagtagtggctggacagcctcatcaggagggtctgttgcctagggaatggaaacactacatggaggagttgaataagataattttggccaggcacagtggctcacgcctgtaatcccagcactttgggaagccaaggtgggaggatcacttaagctcaggagttcgacaccagcgtgggcaatgtagtgagaccctgtctctactgaaaaaa

SEQ ID NO: 2725 - DNA, 1050 bp, artificial
  synthetic oligo
tatctgaaattcagacttgtgggcaccctgtatttttatttgctaaatgtggcaaccctaccccacagataacccccaggatggtgcgatgccctttctgagggtcccacagctctgaaccaacacttacccacctgagagactgaggatctattctgatctctgtattcttgctacgcaacacagagagcctggcatagaacagatggcagtgtttgctaagtgaatgaatgcatatgtgtgacatagcaataaacctgtatcttccggtggaatcagtaagtgttgtgatcagtatacggtgtcagttccgcttatatccaccttcctttcacagtcttggaaaaatcacctcatggtttacacatcccccccagcaggtgagctagaaagccaggagtcatctgtagacttagggaagccattataggaccagttgggttttctgttttttattcagagttgggaggaacgggagggagacgaccatcttctggcgatatgaaagtcgagaaaggcaaacaggaggggagcaagagaggaaaagaagaggatgtgaaaagcccgaaggaaggcaggagagcaagcaggtaggaataaaggcgaggaagcgggagccagctggcaccacagcgaggagtgacagccgccggcagcaggggccgggagctgggaggagggaggctcaggcaagccgcgctgagcctttcttctccttcccggactcctcaccacccatcctgctaaccaagggcctccaccttgctcgtcgtcagaggcagacagccaggacttggccctcttgggcttcctagctctccagcccgggagttagactagttttccaactcccccggccccaaatcgggaggacaataatgccttccgctccgcgcccgccaaggtcgagttaggaaagacttggaacagaattaaacggctttggggaagatgagtcagccgggcggggctgcagctgccagtgaaacccctgccagtgtgattgggcaacaaccagaagtagggggcccgcggggtggtggtgccatc

SEQ ID NO: 2726 - DNA, 1100 bp, artificial
  synthetic oligo
tgcatttcatacttataaatttccagtttccctttaagagatcaattttgactgtggctattcccaagggggaaaagaggggcaagactgccaagcagtaatgaataagaatccaagaaaggatggagaacaaataccagggcccagaaaccagctaaagaatggaaaagaacattcctacgaaaaaccttgtacctatcatcagccttctgaaatatttaattcaaagtatgcctcataggcatatcttcataattcttcaaacactttccttctataccattctacaccacttctcatggtatgttttctgcacaggtagataccaagacaacataaaccagaccctgacaaaacattctctttaactctagaaaagcaacatgatgaacaaaattaagatgacagcagaatgcccactaaaatgtctcactgaaagacaccacttgcagtggttgcctctggaaaattaagaagttaccactgcatacctctttatactctgaattttttaacatgtatatgtattacttccttttaaagtacacgttaacctttatgttgtcataattagaattccaaactctgaatatacttcaagatttatgtagttttgattattaaacagacaacactcacctactgtatcacccaatatctcttcataaaataatcactaaagaaaagtatgccagctaacgtgggaaagtaacttgatctaatctgtggttttctgagaccagaaaagagccattctctttaggaaaaaaaggcttgctaagataaatacactaaatttcactgcagccatttgtgctaaacacgacaaactgacaagacaaatcccacgtggaaaatatagttgcttccagatgcaaaataattattgaaaatcaaattgtgttttgtagctccacagcaacatatcaaagcagaaaggaggatggcctgagctcataacttaaacatgggtgaaaggcagagagataaacaaggaaagcacataaaacattataagttctcaataaacctaatggtagaactgctctccaagcagccattcctaaatcacaccacactgtccagagttctgatacaat

SEQ ID NO: 2727 - DNA, 1100 bp, artificial
  synthetic oligo
gatagctcaataacaattgccagggtttacagtgatttatttcaatagataccaaatctggggaaaaaatcctttgcacagctactgatacacaaagtgatcaataaaagcctttcataatagtacctagcattgaccacagtatgggaaatgggggcaatcatgtatgctgctcaaggaaaatagacaactcaagtcttaaaaatgtccataaccagtgacataaaaattccacttctaggagtttatgctaagtaacttgctagtaactaggaaataagagccagaaatcagtatatgactccaagagcaaccccttacaatccactaggttaaaaattgttttttaatttgcatttctccaattacccgctaagttgaatcttgctggacgtttactgggtttgttcttttcttaaatgccctatgcccattttgtcattgggatattcatttctcctgatttagctactgaaaatattaactacactgggttacaaatattttccccagcttgtcatgtgtcttccccctcccccaccccacctgagcttattaaggggtaaatggtatacaaaaaaactgcacgtaattcatgcatacaactgggtgagtttggatgtatgtatacactcacgttgccatcaccacaatccaggtaataaacatatccatcacctccaagtttccttgtgtccctacgtgtgtgtgcatgattgtgtgtggtaagaatacttaacgtgagatctaccctcgtaacaaatttttaagtagagtagtccctctgtatccactggggattgattctaggacccccatgaataccaaaatctatgctgctcatcctttgtataaaatggcaatggtatttgtatataacctatacacatcctcctatatactttaaaccatctctagtattacaatactgaattcgatgtaaatagctgttacactgcattgcttcaaaatttctatttttacttttgtattgttcttttttattgttttttcccccaaatatttactatccagttggttccatctgcaaatgtggaacccacacacggagggcagactatactcaatacctgactgtt

SEQ ID NO: 2728 - DNA, 1350 bp, artificial
  synthetic oligo
tgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgt

SEQ ID NO: 2729 - DNA, 1900 bp, artificial
  synthetic oligo
ccctgatactttttttgctgtttgcattcaacttacagagttagaacgttcttttgatagagcagttttgaaacactctttttgtagtatctgcaaggggatatttggtttcctttgaggcctatgttggaatacgaaatatcttcacataaaaactagacagaagcattctcagaaactcctttgtcatgtgtgcaatcaactcacagagttgaaccttaattttttagagcagttttgaaacactctttttgcaaaatctgcaagtggatatttggaacgctttgaggcctatggtggaaaaggaaatatcttcacataaaaactagacagaagcattctccaaaacacgtttgtgattagtgcattcaactcacacagttgaacctttcttttgatagaggatttttgaaacactctttttgtagaacctgcaagtggatattttgagcaccttgaggccaatggtggaaaaggaaatatcttcacatagaaactacacagaagcattctcagaatcttccctggatgtatgcattctgctcacagagttgaaccacgcttttgatagagcagtttttaaacactctttttgtataatctgcaagtagatattttgagcactttgaggtctatggtttaaaaggaaatatcttcacataaaaactagacagaagcattctctgaaacttctttctgatgtgttctttcaactcacagagttgaacctttctgttgatagagcagttttgaaacactcttttgtaaaatctgcaagtggatatttggagcgctttgaggcctgtggtggaaaaggaaaatcttcaaataaaaactagataaaagcattctcggaaacctctttgtgatgtgtgcattcaactcacagagttgaactttccttttgatagagcagttatgaaacactctttctttagaatctacaggtggatattttctttccattgaggcctatgtaggaaaacgaaatatcttcatataaaaactacacagaagccttctcagaaacttctttgtgatgagtgtattcaactcacagagttgaccatttcatttgatagagcagttttgaaacacactttttgtagaatctgcaagtggatatttggagtgctttgaggcctatggtggaaaaggaaatatcttcatataaaaaccagacagaagcattctcaaaaacttatttgtgatgtatggattgaactcacagagttgcacatttcttttgatagagcagttttgaaacactctttttgtagaatctgcaagtggatatttgtagcgctttgaggcctatgtaggaaaatgaaatatcttcatattaaaactagacagaagccttctcagaaacttctttgtgatgtgtgtattcaactcacagaattgaacgtttcttttgttagagcagttttaaaacacactttttgttgaatctgcaactggatacttggagcgctctgaggcttatggtggaaaaagaaatatctttacataaaaactagacagaagcattctcagaaacttcttcatgatgtgtgctttcaactcacagagttgaacatttctttttagagagcagttttgaaacattctttttgtagaatctgtaagtggatatttggatcgctttgagacctatggtggaaaacgaaatatcttcccataaaaactagacaaaagcgttccccgaaacttctttgtaatgtgtgtgttcaacttgcagagttagaaagctcttttgataaagcagttttgaaacactctttttgtaggatctgccagggaatatttggttttctttgaggccaatgttggaatacgaaatatcttcacttaaaaactagacagaagcattctcagatactcctttgtcatgtgt

SEQ ID NO: 2730 - DNA, 1200 bp, artificial
  synthetic oligo
cttaaaaccaagtacatattggaacaaaagaaaatcttaaaagtctcctccatgaatattgttaaaaagaaatattgagaaggtaacatttttttatcaccagcaatacaattcagataaaaatatgaagcagagagaagatgagaaccagctattttaaataaactgttgagttttatattactgtatttatcagactcatgacaaatttcagaataaaagctatagtgtctatttgcatctgtctgtgtatgtttgggtatgtatgtatgttatgtatatgcaatattttttatttccaaataacattaccaaattaattcctaaaatcatatagtcttttctgataggcttagggataatcacatatgtaaataaaacattccttaaacttccagaaatatagaaactaatcaaaatgtttttcaagtatatgtaattacataaatttggtaaataagactagtttgatattattggtttaacaaatatgggtatgccttctgagttatcagcattaagtacataggggaagaaaaatactttccaccctttcaagttctcagatagggctctaacaagagaaatattgacagataaaagcatacaaatgcatttattattagttttttgtgacatgaaagccttcatgatgaaatgaagacctgaagaaataattaaacctgagtttttttatgataggtttgatgaagagtggaaagttttggaagaatgtcataagacaaagggtatgagctaagtgtagtaaactgaaaggatcttaacatagctcgttcattcaaattcctctcactgtccctccatcttcagagataaggatgctcctttcctctgggtattgggagggaacctgttatataaatctgttattatctacattagtggagaaggacagaggaatgtcagagtccttcctgacatttctcaagttcttttagcttaaaatagttaacatgccaaggtgccatattttgtgatagtgtcttctaaacctatcgagtataatatgaacatacgtttttactctacttggttttactagtgaaataaggtaatattgtaacagtgaaaaggaagtttagcacaactaaccgcatttcgctcctagcctctgcatggtgatatcttttaaattacttttgcttatctctgcatgcagggcaaactaactatggaagg

SEQ ID NO: 2731 - DNA, 1300 bp, artificial
  synthetic oligo
ataactgagaatgtcaccaaaatagcacagtatatgtagctttactctcctccacagaaaaccaaaaagaactagccactgcccagattatcaaaaggaatattccagaactcaatgactgaagttgtgacaatcccagaggccacagagaactgaaaaactgcaagcaaaaggtaaaatagctccttccccaagctgccaggcactgtgtagaaaggcaccctcaaaatcaaggttcctataatactggaaaaaataaaagtggacagctagcttccccaccatcttagattcctttccagaaaaattattcctgcctcaacctgtaagaagcctcttgaatgcctgcagagtaaaaaatcccaaaggcagctagagttagagggtgggggtggggttagcaacacccagtgcatgaaactccagcttcccttcatctgacctcaaaaaagacaccaaatcagaaaggctgtttaacagcatcacgttgcaggaagcacacttcatcagtcctctgggaacaaacctccatccagctttcccacagagctggggtatctttgggattcctccccatccaggatgagtagcactctgaaattgagaaagactatgtcaaatctgggttcagggtgccatctagtgttgaaaaggaggcagtgatctcaggctaagggaactaaatagtcactctgcacaaaacctctagacagacatacttctgaaagaccaaaccaagccagacagtgaagactggaataaagaactaatccttcaatgcaaatgcacagacatatatccatagaaagagcaaacaggaaaccatgacattcccaaatagacaaaataaggagccagtgactgaccctaatgagatgatgttgtgtgagctctcagatcaagaatgcagaatagcaattttcaggaaactcagaaaatgccaatgtaacacagaaaagcaattcagaaatgtattacagaaatttaacaatgaaattgaaattttaaaaaattaaacagaaatcctagagctaagaaatacaatagtcaaactgaaaaatacatgggatggtctcaacaacagaattgatcaagcagaagaaagaaccggtgagccctaagactatttgaaaatacacaataagaagagaaaaaataatgagaaaaatgaagaacgccaacaagatctaggggatagcctcaaaagagcaagtcaaagggtcattggctttaaagaggatgttgagaaagaacaaaaggtagaaagcttattcaaagtaataataacagagacttttcc

SEQ ID NO: 2732 - DNA, 1150 bp, artificial
  synthetic oligo
cttatattaaataataaaaataataaaacaaacacacactccatttgacttctaaagtgctatcaaacttgagaagtaggcagaatggctgattcataataggggaaactggttttacaaactacttttcatccagaatggcatacttcttttttattataaatacgatgatgaaacctaaaatatccccaataaaagcgaggatgggttgtgatatatctgttcttcctgaggtagcctgcagttgaagatagtcggttccagaaaacattggcatgaggcaccggaagtgatattctggacaaggtgattagatgaggttctaaagttgtgaggtgcttttttgaaaattagcaacattatctttgatgaatgaggttgttttcttaaaagtaagtggttgaaaaaacttacagtccacagatgacacctatcaaaagcatactgaatttagattagtaattttgattgtaagatagttctgtgagcagacaaaagatgggttcttttccctccctattggtttttaagccatttcaggtttcgtttatctgataagacgtggcgagagagaagcgtaataatggaaaagctaaattttcttttttttgtaaatgcttttgagctaaagatttttaaaaaggatatatagatgccatttatgattaaatttattgggtgaatctgtcaagaccgcaaactttgttagtttggggtaaaatgctttgctttgggagctttcatgttgtttgaggttctttgggggtatagtttaaattaaagcacaatataattctagtaccactgcaaaataacctcagagagtattgtttgttttgtgcattagcaagctgacatgcttctagttgctagattccaaaggtaattttttttttgttttggaaaagcttttgatgaatttaagtctgaattatttgaaataatagtgtatcatatgaatacttgctcttcaccttcacatacttagagaaccctgcagtaatttgaatccaatctagtattccattgaagtgagtatgactatgaagatgccgcatactcttaagagcatttacctagggtgtcgtaatcacattataaaataaaattgatggcttattttgcaaatgctatcaaagcacttgttcag

SEQ ID NO: 2733 - DNA, 1550 bp, artificial
  synthetic oligo
gagaaagtcactttttggaggtaatgggtaaacctcacagatataacaagagaattgttgaggcacaaccccttactttccattccgctaacgggattagcgcaagagatggctgccgcgttcccccaggcatttgggagagggacaactttaggcgacttaggggaagactggagaacagggccttatagaaactcgacaaaggaagaggtgcagcgccaccagcacgcaggcaaaagggccgaacccgccaccttacctgctcctccacaccgtgatgcggttaagcgcgtaccgctgcaacttatggtcgtcacagaacagataaaccgtcacctggtcccactcggccctgctgagccaggcgaccacgatgccgtgggccgagagtggcaacgaccctttccctttaacgcactttccgtaccacgcactccacacgagatccatcccctgggaacctagacctggcccggccccggattcccacgacatactgagctcaacaacaggctctgtgccgcgccgctccgcacagccttcagctcagcgtgctaccctcactccgaaccgccaccgcaccagcagccaataggagagcgtgaccccatacgcaagcccgccttccagcgtcagcatggccaatcggaacgtcagaattgggcgccgacctaatgacatgcggggttaaaaactcaccggccggaagtgttcttttcacaaagcaaaccctccaggggcaagagttcagcctctaggttccgccaatttcctggttgctaaccggcttctgtaccagaccggaagcggtatgtcttcactgcaagaggaattttattttgctcccctcggcgggtggcagcttgattgtagtcatccagtgaactgaaaatgcgattttaagtatatttttattgccgtgaatcaggacctaacctagtaaaacactggacactgaagcagggctacagaggaaatatctcatatcgaaacagttacagttgggttgaaaaaatctgcttttgtggcaggtaaccaggggccctgccttttaaattagtaccagcctggccaggcgtggtggctcacgcctgtaatcccagcacattgggaggcccaggcgggcggatcacttgaggtcaggagttccagaccagcctggccaaaatggtgaaacccggtctctagtaaaaatacaaaaattagctaagcatggttgcacatgcctgtaatcccagttactcaggaggctgaggcacaagaatcgcttgaatccgggaggcggaggctgcaacaagccaagatcgcaccagtgcactccaccctgggtgacagatcgagactctgtctcaaaagtaaattaaataaatacatacataaataaataaataaataccagcctagagacctgagttttactctaaattttgccactaactatgtggacttagactagtctcagttttcccatctgtacagtgagagttgtagactggtctctaggttctctgtcatagcagaaaattgtagaattttactctgccaacatt

SEQ ID NO: 2734 - DNA, 1650 bp, artificial
  synthetic oligo
atgtccccctttccctcttctgcctgagtctaaatgtcccttttcctttgacctacaatgtagaagattcttgctaagagctggatgaggaaggcttcatggggtggggcggggcggggggtggtgggtcgcatcaactagagtgcaattctatgtgcgaagagggaaaagcccagcttccgaacctccaagatagcttgtttaaaatttctattgaaagaatctaggggtatttacctctcagctctggacgctgagttttcagacctgcatattttgggtagaagggcctgtgtcaggctgtgaagccagttcctggcaggccaaatgtggcaaagaaccattcagtaaagcagccagcccagcaacacaggcccaggaggcagcttcggagctggttcagctacagaaggtctgagacgcctcttccaagcccctttaggaagcctgactctctggctttcaagctgcctgctgtccccaatccctctctttctggtgcagacactgaagaaaacggttgtctcttgtttcctgcctggagcagctggggctacttgaatattctgcgggatattcctggaaggtgacctccctgtatcctcctctttcggagacaaaggcaaagcaggatgtggttgggaattacacttttaaggaacaggaccattaggtgacgctaagcctcttagccactatgtggcgccatttacccatttttctgtgcaaggttagtgggcggtggctacacgcaaagcaaaccaaatatcaaaactcgaaaacttttcagggatctagttctgactaggctcctaatatgttgagggtacttgggcaaatctcttgacctctaggcgcctcagttcctcattttgtgaaataggagacagatggtgggggggtccctgaaatcccttccagcttcataattttgcaactatgtgagtgaattcccaatgaacatccaagcgatgcaattttgggcctttgggtcacacacagggtgggtaaaaaaaaaaaaataaaagcgcacaagggccaaggcatgggtttgggggtgagggtgagaagggggtggtcatggaagcagggatcctctacaacacatgggccaggatttttcttgagctttccatggcgctagggaaaagataaggagccattcatttgcttagtaaacattgatcacaaactagatgccaggcactgtgtgatagaggcaaggctgcggtggtgggtgggagagaagtgaatggtgggtgggacaccaagatgagtaaacctcaaagtgtttaccagccagtggggaatagatgagtaaacaaataaccagtgcacaaggaagaatggagtctgtgctaaatagaactataaactgctggaggtgacagggaggaaggagggatatattctgaccagataagaaaggtctcacagaggaggagccattttaactgggctttgaaagatgaacagatgtctgtgtgtggtgggggaggggtttggagaaagggagagcaggagggggagggaaaggcaggcattctgggcagaaggaatggcttaaggaaaaatgagggatgggtacattatgctgttttggcggaatagggagtagtctgaggtggcaggagagacggagtgggaaaa

SEQ ID NO: 2735 - DNA, 1550 bp, artificial
  synthetic oligo
gcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcac

SEQ ID NO: 2736 - DNA, 1200 bp, artificial
  synthetic oligo
tgtgcagaggactttctcagctctttgccatgtgcacccctccgtagggcagcccacaacatagcagcttgcttcatcaaggccagcatgggagaaccagagtgccagaaagacagaagtcagtttttttgtaacctaattttggaaaggacacctgaccacttttgctgcattctatgcactagaagcaagtcacaagtccagtccacactcaaacggaggagcttatgcaaaggtgtgaatacgaggaggtagggactattgcaggtcgttttagaggctgtctaccacaatttttaagggtagatctttgattactcttccaattcctttcatggttgttggtctaaccagttttataatacttcttagacaatgttggtaatttatcatttcttagaaaatatttttgtctaggttttcaaacttatttgtaaacttaaaaaatctcatctaggtctgaggttcacttctattattatttatgtcttctctctctttttctttatcagaaagaatgcttgtctatttcattggttatttcaaagaaccagtttttcatttatttgctcaattctattttttgtcttttctttcattgatttatgcttttatctttattaattccttccttttaccttcatttgagattacttgtgtttcttcctagctcttgaaagcttgatttatttcttttcaatatttcttgttttttaataagtgcacttaaggtcacgcattttcctctgagtactgctttggctccatcctactagttttgatatatagagatttaattgcttttcattttgcattggttcctaatttccattttgatttctctctaaccagattagaagtgtgtattccatctcttattttcaggggcatagattcaaaaccatcattttactgctaaattgttattttattgaccctgtggttattatgtgaccctatgtaactcttattatttggaattggttgagatttcccttgcggcttaatacatcatcaatttttttaagtattcaatgtgcatttgaaaagtgggtgcatagtctgttagtataaacatacatatgatcaatttgctagttgtatcatttcaatcctgtacatccgtgtttagttagtagattagtaagttagcacttgtgtaaatttcttaggaaattatgttatttataatataattgt

SEQ ID NO: 2737 - DNA, 1100 bp, artificial
  synthetic oligo
tgccaatctgatgagtatggaacactggctttgcttttccctgaattactagagaagttaagcatccttttacagtttttgaccatatagatctcttctctgaaatgcttgttcatatcttttgtccatgtttctactggggttgtttttatggttattgatttctaggagttctttgtatattctgaataccagatgtcagctgtatttgtaccgttgcaaatatcttctcatagtcagaattttctttaaatgtaaatatgaaattttaaaagcacttaaaataaaccatgggagaatgttttttcataatcctagaatggagaagacctttgtaagttcaatgaactatagaagagaaaaaaaaagagaaagagaaaagtttcaactacatcaaaaaaaatattctggccagcaaaaaataaacaattctaagtaaagtaaaagacaaatgcagagccaggcacagtggctcgccttgacaacttgaagccaggagttcaagaccagcttaggcaacatagcaagaccccatttcaattaaatatttgctgctaattgcataaaggactaatttcccaaatacatgaagagctcctataaatcaataaaagaccaacaaaccaattttaacatgagcaaaggataccaatatacattttattagaaaggaaatacaaatggcatttcaacatttgagaagacgttcaagctcagtgataaaaataaaatgggatgtgatttcacccatcagactgagcaatgagagacagtttgataaacactgttgttgaaggtgtggagccacaggcaggcacccttcaacattgccggtggtagggtgaggttacttggtagttagagcctctgtagtcagcaagttggcaatagctatcaaattactaatgcacatactttttggcccagaaattctacttctaggaatttgcttacagatatacttgcacatgattgaagtgaaatatgtgctgttatattccttacatcacagtattgtttttaatagcaaaaaactagaacgaacctaaacgtttatcaagagggaaatgaatagttgtgatggtggaagacctactgta

SEQ ID NO: 2738 - DNA, 1000 bp, artificial
  synthetic oligo
caaggtttggactaggtgacctctaaaggtccttccatctaaaaagttccacgatttcagtatgtgtgtgttgatgcatcccacggaatctctgtacatctttgtttttcttcaaactgtcagcctatttctctgtcttttttccctctctctttctccccccttcctttcttccctccctttctgcagttccctcttcctcttagactctgtcaagctccccgacctctttcttcctctgagatgttctgtgctgcctttcaccattgctccaatgctgttcttcagtaagcacttatttatcccagctctgggcacccctctgccacaggggtcccatatgcactcagggtaccaatctggccaacttagggcctgagaaagggggactgggcagccgtaataattaacgcctaggctgcctaccatggtcctctgctgccacctgtcgttagtccggagtgacactgctctgggggctgctgagcccacaggggccactaccgctgctctggccgacaggaatccattacatgcagtgtcctgccaggcctgatttaaagctcatcctgtaatccgtcttgcgccccctctgggcctgtctccggtttcctagcctgtgaaatggatggaagttgtcttcagctctggcagagagaggtgaggagtagaggctctagggacacctggctttgcagcctgcccctgtgcttgtcctggtgggtgacctggggtgaatccttccccatccccttctttgcagcctgcagtattgaaatggatgatgtgggaagacatggttgagagaaaaggggcaagatggattcctgtctttcacacaagcagtacaatgctgagaaactggaaatggacatacccactgcatctacaaacctttggccaggtcacaactccatcttagcagccaagcctttctattcattcacccattcacttattactcacccattcattccaccaagcagcctggggctgtggg

SEQ ID NO: 2739 - DNA, 1250 bp, artificial
  synthetic oligo
agcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggtaaggactggcttccgcagccacagcagccgccctgggcagcggcagcggccgcagtgggaccgggagaaaaaaggaagtctccctttctacccaccccaccactcccaccgtgcccagtgcagcactaccagtgccaccctgggaccttccctagtgaagaggcctcagggattcaggtcaggtaaccacctggctaacttctattaattccgggtttgggcaccttaggcctggggcttcctggcgccctgctccctcatgagtggggaggggccgcagggccctgggctgacaatgaggtggcaggagggattgtgctccccccagcctccatcctcagccagccatgcccctctcctttcagaggctggaactgaacgtcctgggactggctggtgcagggggaaggccaaagatgggaggaagaatatttggcaaccaaaccctcaccctttggcttctgccagtgggtgagaggacgagcactcctggtggtggggcacaccacacacttgaccttatgtgacctgaggtgactggccagagccgaggcaggtcgagcccaggggctgcctgtcttctcccaaggaagtcacctgcaggctcttctc

SEQ ID NO: 2740 - DNA, 1800 bp, artificial
  synthetic oligo
aaatataggggaaaaatcttcatgacatgaggttagacaaagagttctttcagtttgacaccaaaagcacaatctataaaagaaaaaaaattaataagttgggcttcatcaatattaaaagcttttgctgtaaaaaggaccctgttaacaagaatgaaaagatagacacagattaggagaaaatgtttgcaaatcacatatcagacaaaaaaacttatatccaaaatgcataaagaactaccgaaagtcaacagtaagaaaacaacccaattgaaaaatgggcaaaagatttgaatggacacttcaccaaagaggatatacagaaagcagacaagcacatgaaaagctgttacgcatcactagctattggagaaatgcaagttaaaattatgatgagctaccaatgcgcatatattagtttttttttcttctttttttttcttttcttttcccccagtgcacatatattagaatggcttggccatcttcactacaaactaaattaggagcctacctatgtgaacttcctctttgataaccctctccaagacgcctcacttgaacgtgacaagagaaattggaaccatcttctggtgtcaaggccataatacctaagggagtgtcacacatacataaatgcttgttcttcatcattccttcttcagatacccttgctttatgtcacggaactctttttacatgagacttagctcttccacatttggcttctatttctcctatatctttaaattccacttttgttaccgtgcacgacactgatgacactcgggctgggtctggaagccttgctctgaaaaaaacgttcctcgtctcctgccgggtcatatctgcagttccaataggttccacaagggggatggtgttacccaggtaagggctcttagaccgcctttaggactggtggatgaatgaatcagataaaaggcacacaactaatccgtctatgcttttaaaataacatcacatttaaataacactatacatgctgactaaatagtaattatcaagtttactactgaaaagagaaaacatttgcttatttcgttttcaattggtctacagatatttgttgaacacctactgtgtgccaagctctcttctaaatactggggaaacaaacaaaatttatttgaaacaaaatataaaagaaatgatacacttaggctaactttaattagtgattattcttatttaactttatctgaatttccttctgaagcttaactggcaaatttactctcctctttgatgaagggcatagatagcaaggctttttctccatggcaggcttcccataaaactcctcccaccacgctttcctgtctaatttgaatgcttacaacaactatctcgaccagtgcttatgagggcaattcagcctattacaaaggtttcttctactccataacatgactttttaaagcactgtccactcagcctttttcctgctattttcatttatgtccaaaatgcaagagacaaagaactggtaggtaactcccgagtttcttcttccctgaaacttttatctgctatgacatggtacctggtcaaagaagtcattcccttagctaagtctttttttattcaccatatgtatacttagcccctctttctcatgaatgcagattttttaaatggaattcattcgcactgctgtaacatgtatcgtgtttgcagttacagcctgctatggccatttgctaacacagacttccccttctgaacctttgtgatacttttgaatggaacaaaatgaacacagtaaagtgttttttg

SEQ ID NO: 2741 - DNA, 1000 bp, artificial
  synthetic oligo
tgtattttattatatcacctttttttctcatatgaatggttgggtactgtatgtaatgattgtatactctttgtagctttgctttgttcagtatttcctggaaatcatttcttaccagttcagagaagtcttccgcattcttttttgcaggtgcatagtacttttattgtggacatgtgccatacatatcaattcaccccccttcctatgtatgcacatttaagttgtttccaatgttttgcaattaaaaacatgctgcagtgaataacctgtgtgtatatatttttgtattgtcagaggtttatcttaagggtaaatttctagaagtgggattgctgggacaaaaggtaagtacatttctacctttataaggtattgccatatttgcctccagaagagatgtaccagtttgcattcctaccagcagtgtatgagaaagcctgtttccccacagcctcactaatggaatgtattgtcatactttttcaatttttggcagtctgataggtgagaaatgctatctcagtgttgttttactttgtatttctcgtattatgggtgaatttgagcattttttcatatgtttaagggccacttttatcccttttgctggtgaattgtccatgtcttttctcatttttctattgggttttttggtcctttggcctctttttaaaaataaattgtggtaaaatatacataacataaaatttaccattttaattattttaagtgtacaattcaatggctttaaattcattcacaatgttgtgcagccatcaccaccatccacctccaaaatttttttcatcttgcagaactgaaactctatacccactaaacaataactcctcatttcctctctcctcagtccctggcaaccactattctgctttcagtatgaatttgactactctaggtacctcatatgaatggaatcatacagtatttgtcttttcatgactgacttgtttcatttagcataatgtcttcaaggttc

SEQ ID NO: 2742 - DNA, 2350 bp, artificial
  synthetic oligo
acgccactgcactccagcctgggtgacagaatgagaatccatctcaaaaaaaaaaaaaaaaaaaaaaaagaacctctgtatccctaatacctaggtcaaggtcttgcacagagcaggtgctcaatgaatatttgctgaattgaactgagatgtaaattctgcaggagaacttagaatagacctgtcgtactagagtggttcacagcgtggactctggagtcaaataatcaggatttgcatcctgattctgtcacttccagctgtgttacctagctgtgttaacatctttgagcctcaatttctcattggtaaaatgaagataataatagcatcagcttggtaggatttgggtttgcgtgttatgcacttaggactttgtaaagacccaataattggtagctaaaaacaaaacaagaactgcaaaaaagatagtctttcttgtatgtcatccttcctccattcccccgacaagctgagccaggagagggtaaggagatgtccttggacaagtattcctaagctctattccagacccatagaagggtttctctctcttcaaatcccttcttaccttttcacctgtcctggactttcatcttgatatcctgaagttccttcccccatcataaccatgcaggggtggagtggaggagataggggtttgtgggccagggacaaggacttagagctttctgttaatccctgttctagggttgagttctttactggtgatggtagaaggtcaagtgtgaggtcacagtaatttcagggcctagagactgagagaacaatagtcttgtgtaggaggcattgacaggacagcgggcctcatatgctgccttcttctttggtcccctgtaagagaaagcacctccctcaccctgctccaacgtcctttctgtccatcctgctacctcgtctttacttctggtggccccagctcagagcaagcctggggacccattgaacatctccctgcaactccctcttggaagtggggtggggtggagtgggcagaggacaggctaaaactggcgatataagggcacaagatcgggtgcctgagctttctggtggcccacgtcctctgcccccgcccttagagccaacagttccctagagattgggggagctggggctgagcctgggggcgccgctgcctctgttcctttaagtagccgctgtttagcattcctgccgccgccgctgccgctgccgctgcctgcctctgcgcgctgattggctggaatcaactgagaagggagccagggagagatgctcttgactccactcagatccatcctggggaccagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtg

SEQ ID NO: 2743 - DNA, 1650 bp, artificial
  synthetic oligo
tcttctgattctttctacctatcataatctgtgtgtttgaagtctgtcatccagttgcttccccagtgtcatcgtcatttctaattttttttttttgagatggagtcttgctctgttgcccaggctggagtgcagtggtgtgatctcagctcactgcaacctctctgcctcctgggttcaagcgattctcgtgcctcagcctcctgagtagcagagattataggtgtgcaccaccacgcctggctaatttttgtatttttagtagagacagggtttcaccatgttggccaggctggtctcaaactcctcatctccagtggtccgcccacctcggcctcccaaattgctggaattataggagtgagccactgcacccagcgtcatttctaaatttgataggcaggatgttattttgtagcttttcccttttatatcttcattcgagtcattggtagtctgtactatatgcagaataaatatcgtctgttgctaccacttgtttcctgtctctacaatattttcctgcctataatcaaatagaaccaaataaacaatacaggttgagaaactgagcacctctcagctttccaaattaataaaaaatgtcatctttaatttttgacaattttcctgtcattaggcaggtagatggatttggaagcagaggcttagaggagagacggacttggaagcctgggtgtgtgtccagttcgcaatagggaacttgtagtttcagtcccctttgatgccttattgggctgttaactatgtcttgaaacctctgacatgttagtgttttgcagaagtggttcgtggttttgttggtcagtttttagcatgtttgggtgggtgaaaggagaaagtttgtattcctttttttttttacatttgttcctgaggagccaaaatttgagaatcacagagtccaggtttgtcctgtcagacctctatatccagttggcacattcaataaatgttgactcaacaggggtgcagatcgccacactaaaccttgagaaggaagcaaaaaccacatcaaggagcttatattttagtaaatgacatcaccactaattctgagcactagattttaaaagggtgaggtagtggagggttaggaaactatgttggatgaagaatggttaaggaaataacaacatttagcctggagaagacataacttttttttttttttttgagacggagtctccctctgttgcacaggctggagtgcagtggtgcgatctcggctcactgcaagctccgcctcctgggttcacaccgttctcctgcctcagcctcctgagaagctgggactacaggcgcccgccaccacgcccggctaattttttgtattttcagtagagacggggtttcactgtgttagccaggatgatctcaatctcctgacctcgtgatccgcccatctcggctaagacataactttttgaggacattcttgagatcattcttcattatggctgatattatcccaccttttccatgtctccaaggaaaaaactcagattctttgcctttgatcctttctcactctacatccaatcagatgtcaaattttctcccttcaagccccaatatatttcttttttgtctttctccacttttgaaggatccaacatatttcttgat

SEQ ID NO: 2744 - DNA, 1650 bp, artificial
  synthetic oligo
acacagacctagatagtgtagcctgctgcacacctaggctatatggtacagcctatggctccaaggctacaaacccatacagcacgtgactgtgctgaatactacaggcagttgtaacacgatggtacttatctgtgtatctaaacataactaaacctagaaaagatagagcaaaactatggtatcatctaatggggccactgtcatatatgcagttgtcatatatgcagtccattaagcaggggtcctcaacccctgggccatggacccgtaccagtccatgacctgttaagaactgggtcacacagcaggaggtgagtggcaggcgggcgagcattaccgcctgagctccacctcctgtcagatcagcagcggcattagattctcataggagcaggaaccctactgtgagctgtgcatgtgagggatctcaattacttgctccttataagaatctaactaatgcctgatgatctgaggtggaacagtttcatcctgaatccatgcccccacccaagtccgtggagaaattgtcttccacaaaaccagtccctagtgccaaaaaggttggggactgctgtgttaacttacatgccattatgtggcatattgctgtacaaatggccctggcctttccacaagccgtagcatggccacagagatatagaaagagcctgagtgctcacgaggtgattatctgaggtctgtcacaggttcccctttctttgctttcagaggcatctctgttcacagcgtctcatcacactcaaaacccaatgcctgtttccttttttttttttttttcaaaagcagagtgtgtggcaacggggctctgaggaaatccctaccactgtggttggggagggtgtggtgtgaagaacccacattgtggcttactcaactgtgagatcttaactctgtggccccagagccactgtgctcctgggcggcagtggtgacagccatggcggcacagcttagagcctggaatggtaagcatgggctcaattgcatcctgcaagaagactcgcatcagggtttgagctcggggtttggtgtctgggtgggtgtcggcagaatgggaggaggcaggtggctggagagcactggggacaggtggagcagccagttttgccctggcctgagtcaggccaggtttgggaagcatttggactccacagcaggcttgggtgctcggcccctggattgacaggaagctgagaaatgtgattatctcccacgggacaacatgctgtccccaaacaaaggtggcggtcgcatgcccactgcctaagttctaaacgagccctcccccagccttttctccccaagctggccagctacaagacccaaccccatggtggagccgagggttcagagcagctaggcacaggagaaaggaatttcctcctgtggctgcctgggagggagctctttttcatcggccccacctgccagcttccccattaccaggccgaggagtggaacaccagcattccttttcccttcctactgctgcctcctccagccctgcagcctagaaactctcagtggtatcagactcctgaagcaccaggcaacagcccagcttctttctgcttggtcacacaagctgtggcctcccaaatcatgcctgggctaggaagacag

SEQ ID NO: 2745 - DNA, 1900 bp, artificial
  synthetic oligo
tcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgtgttcagataacaaaggacttgccacacagaaaaagagtcgatgtgctctgtgttgctaccatggcagaattaggaccagtgggtggaaacccagaaggaggcacat

SEQ ID NO: 2746 - DNA, 1100 bp, artificial
  synthetic oligo
ctgaaatcaagcagtaaccggttactacatacagtgatccccactacctcatgccgagcaacaaccatagctctctacgaaacaaaaagaacccccatgtgcctcccagttctaatccaacaaggattctgaagattaaagatcacggccagatcttcaatatttcaaaaccccatgactgcatgtaaaatttaaaagtgaatcgaaatttagttttgaaaagcgtttcatgattatttgcatgttttttatttaagtaaaaaacagagggaaggtcaggctttgtttctgagacttgacagattacaaaggttagaaaaatgatcaagacagtatttggataccatagggctgccatcaatatgcgtctccagagtatttaaaacttcttacccatgaatccagcagggtaggttatatcagttcggaccttgccatcgattttaatgaaccgctgcatgcaaatcttctttacttcatctcctgtcagggcatacttaagtctgttcctcaggaaaatgatgagggggagacactctctcaacttgtggggaccggtggatggacgaggagcctgtaacgttaaaaatgataatcactgttgggattcactaaagcactcaaacctacctcctagtccaccagatccactaactgaacaccaagaccgtccatattacacccaacttggacttttacacaggaggtgtaaaaagcatccaaaactatttcataccttaaagttttatagcatcttccctgtcagaggaccaggatcattaagaacatgaatcctgagtccatgtaaatgtactatgtggtatgtggaataaatgaggcacaaaaatattaaatcgattggaagtggaggacagctagatagtatagctccttcaagggcagaggaagccaagaatagatattcctcccctagcctggtccccaaatgagtcctgggagacacttaaaaacagtggccacggaaatatttatataagatacttacaaacacaccggtcaatttatccagcatccaatgctttggagctgccacccgcttcagatgcttcttgggaccacgagcctgaaagttttagatt

SEQ ID NO: 2747 - DNA, 6050 bp, artificial
  synthetic oligo
cctggctcaagtgccaaaggataagggaatgaaggcaaaagaatacctccaaaccagaaaataaacaaacctctgaaaatctcaacttattttcctggaggcctgtttacaaagaagaaaaaaatgtcccatagctaggcacagtagcaccctcctgtagtctcagctactcaggaagctgaggtgggaggatcacctgagccctggagtttgataccaggctgggcaacatagcgggaccctatctctttaaaaaaaaaaagccccatatattctagctttcatgatcaattagagatgtagaatttcatatttataaatacctcttggtccaaagaatcttgaggaccttaaaaagagtctctaatctttccaaggaggctagaattctccgtgacactctccactccgcagcggtcattaagaatctgctcagacacttctagaaagtggccacttactacctctctgtatcatctttgcattgcttacttgggtggatgggggtaggggagggaaaaaatagagaaaggggtaaacatttttttaaaaacatgaggaaaaaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtcagccccggcttggctcgggagcaggtctggcaacagcggcagcttctccgctgcaggctccggatccgggaggtgtggatccgccctccatctattggatggctcccaggccaattgttagaaagaggcatatgttcatctcggcttctggagtgtctccggagcagttgctcaacagccagccccctcccccatccggaccattgaagggcagaaaaaggagcgccctccaccacatttctctgtgcccacatgccagaaagggtctcccccctggtgacttcctgtcatctccactgcttacctcctggggagcaggaacgagaggggcttcaagcactcagctttgaagcacaaaagccacccctttcctttttggggagatgggagaggaggttagttgcagaggctgagagggagcaaaggagacatttgcatttctcggcaaaaatgctctgatcactgacttccccgttggctccagcagagctcagagctctccgctgaactcttatctccaacttggcaactagaccgcgagcttgcgaagcaaggagaggacagggatggtcacctaccgagaacctctgtgctccagcgctgggcctggcatgttccccatccatcatctcatttaattcccaggacagccctttgaggtagggtttaccaaaggtgaatgaaacagagcctcgggaaattgcccaagttcacatagccacgtggctgagtgtttgaatctggatcaggctgtctgcaaagtttttaccctcagccctaatccccgctgcctaggagggtaaggaggctgtctagagtgcaggttcaggggtcagtaggcctgggtttaaattcctactttgccatttgttagcggtgaagtcttaggccaatggcttc

SEQ ID NO: 2748 - DNA, 1200 bp, artificial
  synthetic oligo
aaaaaacatgaaataaaatgtgctataggaagagtcattaatggatgaaaaatatcagtgagcaaaagtttgaagagtaaccgtatatttacgtagtctcaaagtacatctctacaggatacttttttaattacaaaagatgacataataactttacagtgtaggtacatggaagaatctaccttaaccaaatgatccaaccaagcgatcaaagtttacagtatcagcaatgggactaatcaacactatgatatgacacatggaaaagaacttggcattaccttagtaatgtataatctgaatttaatcatgacaaaacaacacataaactgaaattgagggatattctgcaaaataactggtttgtattcctcacaaatgttaacaacatgaaaaatgaagactcaggaactgttccagataaatggagactcaagacacctgagaactcaataaaattcatgattttagatgttcttttctataaagacactattgggctatatgacaaatcttaatagtatctgtagatagttaatagtattggtttaatgttaaacaattccttgactttggcaattatactgtgcttatgtaggagagttcataatttttcagaaataaacactgaattatttagggttagatggggatcgtgtctgccacttactctcaaatggttcagaaaaaaataatatgcgtgtgtgattgagtatagatgatgacatcaacgtgaaagagagagagagagagattaaaagctcagtggaaacatctgatggatctgaaggagggctatccagaatttttattgtactatcctcacaacttttctccaagtctgacactgtcaaattttaaagatatgaaaaaagtgctatgagatctcagaatcagtggaagattatttttactattacagattggaggaagtttcatgtgggtgacagatgacctaggccttgacagagagaaatgcaagaagtagaaatggagtgtggtaaaggagaatattctaggcagaagaaaaaataagaatcaaggtatgaaggtaggcatgtagaggctgtgctttgggtatgataaatagactgttttggtgacagcattcacattgtaagggaagagcaatggtaaataaaagttgaaagtcaaatcatagaggatttagatttggccaatgattccctgtggtagtgt

SEQ ID NO: 2749 - DNA, 3400 bp, artificial
  synthetic oligo
tcgcttgaaccagggatcggaggttgcagtgagccgagatggcgccactgtactccagcctgggctacagagcgagactgtctcaaaaagaaaaaaaaaattccaggcccatcttgaacaccacctcttccagaagcccactgtgatagtgcagtcagatcctgccttccctcctctgtctcctcccagggagcctcaaatcctagactcttttggtgaaacacagggagcatgaagcttctcgttatatggagacctgccttgaattctagcttgtccttgacttggcccatgatcttaggctaataaatgccttgacctcgttgagcctcagttttcgtgcaaaaaagcaggtaataataaaccttagggcaataagggacgtgctctgttcgggcaatgccttccctgctgagtggcgtggccctgtgatttttgaatttggctgattcctctcatatggcagcgcaagcccctcaggacgtctatatccttccacccagctccgccagccctcaggtgcttaatgactgtatttacaggcatctagcgcagccacgcagccccggagctgcatcacctctggctatgcagtctttcacttatcaggagggttaatgagatgcagggtagaaaggtcttgccactcgcccgcccgctcgtggaagccgagtagcttggtaacgacaccacgacttcacgtttagtgcattagacgcgtagacccttaggggaggcagagcttcccggtatcgccgagcgggccctgagggctgaggctgggcacccctgcgcacccctgctgagtgcccggccaccagaaagacagatcccccacctttccttctccctgacccggcgcgcttcctggggaacaaactctcccttaccctcagtggggctggggcctcagtctgcgacatacagtgggactcccatgtctgcatgcctgaggtgggcggaagggggcggtgggtgctgggaagacatccgtccgcttgcagctccgctgagtctccagcacctgaaaagccgcggccgaggcctgagggaccagcccagccgagatatcgggggcggggcagcccaatcccaaactggcggctggacccgactccaactcgttcctcctaagtccgggacagattgtcgggaggagcttgaactgagcttcggctcccgactgggcctgggcccggcccccactggtgccacctccctcccttcctggcccggctcctggcccacactcggccctggcccggccctggcccggcccagacccggcccggccctggcccggcccagacccggccctctgaggctcctccgggctccaggttggcgcaaacaaagccctgattgactgcccggaggggcgggcctcgctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagag

SEQ ID NO: 2750 - DNA, 1750 bp, artificial
  synthetic oligo
taattttaggccacacagaataaagcccctttttttgcagtgctctaccacattcacctcagaggtttggattttaaaaattcttgtgtagttgaggtgggatcagagagccctctgtcatgtttcatggggccttgatctccaggatggcatttggcaatagagagcccacgaatattttctatgggcattaggtgggagtatatttagctcttatctacagactaatgtgaatgacaatggaaaagtttccacagggataagcctcacgagttgcccatgaggacaaaacttttatggtctagtagcatttcctcaggtattgcaccacatagaactcatgggacctgaatcaccaaccttattacccagaaatcaactggtcccaatatcagaaagccaagtagggcacagataagcagaaagttacctgctttatctttccacctttcacttctttactatccccctcttcttgtcattattataattactattattagtattgtttgtaaatccatttctctcttccactcttctcatttcctttatgtttgtcaagtatgcattttttcaaagtttatgcactcttctctatcagcacagaatcccctaacatattcttcaacaaagtgtcactagtgtcactgataatttataccctcttgaacacaacagccaggaagccctaacctcagagatgtgtcagctcaacttcgttttgtgccaaaatgccaaacccaagcctcatttaggtgatgggtgagttcagtggctctctactcacccctttcctcttacacataaataaattccagtgggaggaaaataatttcataggatcttaatgtcattataaataccacttttagttcagcaaaggagaaaacatgaaaagggagtggattactcaacaacttggttgatgtgagcttcagaagtatttttttagttttttgagaaaataaatatatgtaaaacaaatattcaaacacggagaaaattttctctcagcatggactagaaaacataaaactctaatatttctaatgggagaagtgagaaattggtttctgaaacactaaagttgttttgaagcaactgatacttccttctatttatagcttaccaaagcccagtatacattggtgaatgagattagggagcaaagttgtacagtttaagagggtatcctaaaaaaacaaacaacaacaaaaaacctcatttctcatagttttctgaagaaagttaaataagcgcccagcatgaaagcaaagtccagctcataagctgattttggacagtgctgactcagtaacactcttctctgagatctcttttccttgcctactttgctccttcatgagagttttgttaccactgacctccttctgactccccccacttcatgttagctttggactggccaagtagctttgattctcctggaaagctgattcaactcactgtccagtccagcacctgaccttcattaggcagtcatttctgtcttgagaccatgctgaggaacttccctgcactggtctaagctttatttacactttggaaaccacctaaagacttagctctgggagaagatcttcttaaagttcaatactgaaagaaaacctgtaaagtgctctttcattttttagtgaaatgtctttccatttcccagctgctgattcatagtgacacagcatcgtttgctcttcagcttgtattttctcttagcatggccccagaggct

SEQ ID NO: 2751 - DNA, 1000 bp, artificial
  synthetic oligo
tatggctttgactaaatgggcatcaaagagatcacctagaatttattgaaatctcatttttctggttaatacacagcacattgacccaaatggccagttatttgactgaataaaatcttttcttatgaaaattttctgaaacagaattcattaaaaatttatattatgtgaatcattttccttgtcaagactatagattctgcacagggaccctcaagaactggccaagtggtaaacttgtctccaaaacgagcctctgggttcagaaaaaagaacctctcttccagctacaaagtatgtttttctcactgaaagaagatatacttcatcatatgactcaaaaaaagtcttaatggaaaatatgcaaaaaatgaaccccttgaaagatttatttattcctattcgtgaaaattcatttcctctttcattttactgattacagttttaagagctctttgagaaaaatattttttggaaactactctctatcttcattcttacagtcattgtcccaatctaggctctaattacctcaaatgtaatggtctattctctaaaagagatcttcacctcctgttttgccccctcctgcaatccattctgtatactattatctccgtgatcattcaaagaattgtagaaaggaagcaggctgttgagcaaggcacatatgaatttgaatcttgcctctcccacttccttgtttacaatctttgggaagttaattaatttctctgtgcttgaattcattaatgcagaaaatgggagataatattagtccctactccataggattgtttgatgaattaaattagatgatgtgggcgaattgcctagaatggtgataggacatggaaagtactcagtaactaataattttattttccctcctccgactctgtttatatcctttcaattacttcctgtattccatggcttctatactctaaggcatttttgtagaactccatcctccaagcttctttccctctgtttccag

SEQ ID NO: 2752 - DNA, 2550 bp, artificial
  synthetic oligo
atgtctgaccacctgtgatttctaaattgatttcttttctcttttctcaggtctctacaggtattgcttttctgaggtgaaaaggataggtgcagggaatattgataggagaagcccaagtcagaagacaacattttagggaaatagtcggcatcagaaatgtactagttgatatatcaaggtttttaatttatgcttaatacttctaaacagaaactttgaactattgtttaagcagttcagttcaattatactttttatatgttctttgaatgcttactaggctaggtcctggctatatggtgatgaaaaaaggagatctttttgtggcactgatggacttaagagcacagtgagggtaataaccaacaaacaaattaaaaaaaaaaaccctaaattacaaatgttgatgctaaaaagagaaagaacagagagtgtgagagtgtgtaatgatgtataggattacctagatcgagtgagtggttaaggtctcttagacccacagattgagattaaaaggaaccagagatgtgaattttgtgacctcagcaccacttatttaacctctttgagcctcaattttctcatctgcaatgtggaaataatcacaggactcctgtgaggatggatgacataatgaataaagtgtttagcctgtaaataaaaggcagccctaaataagtggtagccatacttaatgttaatgttagacatggtatggagaatgaactttaggggaaggactggaatgtaaacagtttagtaagggagctgttgcaatagccaatagggttgatgacagcagcctggattaggatggtgacagtagaggtggagataggttagagaggattttacatggaaggaagaattacctgggttttctgggtttttattgtctatgggaggaaatatagtggcaaaggtcagaattactccctaatttctagcttgagtgtctgggaggggagtcaggtcactgactgaaaagggaagcacagattcaggaatgaatcaccaatcccacatccctatgagacaggaaccaagaatatgtccagattggaggggagagaaattggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggattttcttgttagtggcttcttagcttctcctttcttatatttcagaaatgacacaattgtccatagcaagctaagtgttccctctaagagagtctatgtttctgctcaaccccaaataaataccttctgcctctcctcatcacggggattttacatctaatggtcactaagaagatttgggggaaaaaaagcccttcttaccttcccttcagtctgaagcaaaaaagaggtttttggaaacaagccatgcaaatctctacgctcacaatgaactgtgaattgcagaagcataagaacccacatttaaaaaataaaaaaggtgtaaacttgacctctagcttgctgttctggcataattgggctctgttatttaacagggaggtgtgaacagaacatgcccattttgtaagtgaaactttctgcaccagtgaagctaaaacaaatagccatttcttttaagtgcaaaagtggaagtgtgactgcaggagagtaaggttatgaacaattcttagttattgaaattgtaatgcactgatggatctttctttgctctctcactgcctgtgtgtggacaatagttgatagtagaagcagtgccaacactaaaatcaaagtaggtggtagggtgggaacagtgtggcataagtagggacaggtgtttacttctattctgattgtccaactagacgaattctagtgttatataagttcctactatgggattagaatggttctgccacaatgtgctcttcacatgtcacagtgaaatcgaaataatgtcttttgtagcaacgtggatggagctggaggccattattctaagtgaagtaacacaggagtagaaaaccaaaaaccaggtattctcacttataagtgggagctaagctatgagcatgcaaaggcatgtggagtgatagttaagacagccaaattctactaagtagtctctcctagtcagggagaggaaagtggcatagtggaaataccacacgcttcagagcaagccaggaatgatagtaaatcctatctttaccattttctagctttgctacttaaggcaatttactgaatgcctctgaagctcagttttttcatctagatcatagggtgataatagttcttacatcttaggacagttgtgaaaattaaattaaataaatacacctgaaaacttccattacagattttgggatacatccttgatcgtcaccacatgataattatttcctgcctttccatttgtgagagtcccttccaccctccattctaagtaa

SEQ ID NO: 2753 - DNA, 1250 bp, artificial
  synthetic oligo
gaaatgctgtatggaatagtccaaccactttaaggtctgttgtatgtttctactctaaatatatggcagctttctacaaagcttagcatttgacctgcccaatttagcaactgattttacacatctctctttttttctgttgtgtcacttctgctagattttccagggcaggggctatgtctcatttcttcttatcttctgtgatatctagcgtgatgatttgatttacagcaaggtattgttcatctcatcactccattcttttgtcctagcttgatagtttagcaaactggagcagcaggaaatgggccaaagagtaaaaataacattcgtcttattttagtcactttcttccagtcttgaatgccagcagaaatgaatgaactcaatgtaaagagaatatctgtgtttctatatggggtagagtagagttagagagagagatggggaacggacaggaataggttgtggtttcttctgcatacagttaagaatattggtttctataccattgtagaaaaaaacaaagggacgcttgtttctggtgatttgtacactggtatttgatgtaaaaaattgacagtctttaacaacataaagcttacatttagatagtctgaccatatgaaggaaagagaaatagctacacacatagtatagaatgtgtagtaaggaggaagtgtgatgtgaggaaatgaacaaaggccttttgaattaaaacttaggttctagttctgattgtgccattaacttgttatataactcaggatgagtcttacttactttctttgggcctcagttaccttgcttgtaaaacagcagagcattcatagagattaatacaaaattagtgaaggtttaatcaagattaataaagtctaatttttatttaaaatgctgaatcagttcttccagaaaatgagaaaatattataagcctcattaatcattatctacatcaccattgaacttatcaatggatacgacatgctacccaaggtgctcattaaatatgcgctgactgagcttgttgaattactccatacataggctgttgaaaaggctccagtgtatgatatgaggaattcaagctgactataacctctcccctattctcctttcatgctactgtgatcctttacgtctagatctgcaatggtacccatgtttttacttaagaaaggctgctaggaaaatccctgcacactccctgtgaatgtcctggatactatcttctagttctctctcatt

SEQ ID NO: 2754 - DNA, 1000 bp, artificial
  synthetic oligo
ctttcaatgttaaacttttatgtaatataatctcatccagcacccaccggccactctacatgcatacaatattgtaatatgtgtgtatgttgagaaaggtgatgctgtttgtggaaaagaaaaattacagtagccgtaggtgaatcacttgaatgcttggcaaatttctatttattgattggtaagtatcaggttaggggcagatttggaagatgcagattcagagcagcaagtgtttattctgtttactttttagttctttgtctggatgcctgtttttagaagaagtgtgttgcccaagcacaagccttgatatctactcattgtaaaggaacatgtctagtgcttgagcctagtttgaaaaatcatgaacaaaatgactgtacagttcacctaaacatgggggaaaaaaacacctcaaccattgtagcattatgttatacttcggaccaggaggtcagagttctaccagctaataaaactcctgtagcgcacatatccccttcatgtgtaacccaagtatttaatattagtttgatgcaaaagtaattgtggtttttgcagttaatatagggaatggcaaaaaccacaattacttttgcaccaaactaatatatgggtttattgggtatctggaagccaaattaaagccaccccatttgttttcttttctttttttttttgttataccttttaggccaccccagtctttctttctagtgagactttctcataaaagggaaatgaacctctgttcaagaccacttgagccctttcccctgacgtaatcaggatgagtacagttgaaagctcaatgagacagggataaaaaattaggcacctgtctgaaccatattttttgtaacattcatatgttagtgattcatgttaggtagggtagcctacacagacagtggcatatttctttttctttctttctttttcttttttttttttttgagatggagtcttgctctgtcgccaggctggagtgcagtga

SEQ ID NO: 2755 - DNA, 1400 bp, artificial
  synthetic oligo
aagtacataaccacttgatggtcattttaaaataaaaataaccagaaattgcatatttgtaattaaactgttactgatataattgctgaaacaaacaattggctttccaaactgtcagagttatgtttctaatctctttgcacctgacaaatacttaggttggtaggtacaccgaaggggcatctgaactcaagctatttgccatgacgtagaggtaaacatcattaccctaacacttgtttaaattttacaaagaaaacaggcaaaaaatacattgaacttgatttaaatcaatctcaagaattggctagttgcttagttttcactctaatgaaataaaatcgtaaaaaaaattgcaaataacatttattaacaattcttttatttatggtcataagttatggtttagaaatactttctctgtttagattttcacaccatacatttaagggaaggaagttagaaataaataaatagcaagccaatgcttaacttacatataaagtcaccctagcccaaattaattccatagggccactggtgttcaggagtctagccttactctctgagtaaataatgatgtagggggtaaacaattagcccatggcacaaataaaagggaacaaaccagcaggtaaatttaatttaaaaatattactttttctcaactgcagttttggaggccagtgtctgttcaacatatttttgggtacttgccaagtcctttagctatggtgggcagggacttgtcatttcctgccatatgaaggcagcaggctatgatagggaaaataaaaatagcactacattgccacaaagaagtgtggtctactccattctggtgcgtgtgtgtggagaggaggtgatgctttttcttcaactgacttgctttcgtttttactttctttgattgtaatccaatgtggctgcataaatgtatttccacaagagttgagatttttaaatgaggcaatgactgtgttttgagttgtgtactctgccttagctcatggattgcaggtaaagatggtaattttctagttggatgatttttttaaaggttaaatggacatgaagctagaggggtcattgttgctgcaaagggggtggtttattttgcttgttattaaagttatttcagtttgcttcacaaacacttaagtgaacacattgtgattatttgggggaaaccatgcaggaaatcctaatcagttcaatgggcagtgttcaaagcacctatttttatccattggcaggtgaccagtaaggaagagcaaatttcccggcagataggcttgaggggagaggagagacaagggtgtaaagaaaaaaaatctgaatgcatttatcagtttaaaaaaaaggttttaaaaaaagtgtctttgaaagtttcaaatgta

SEQ ID NO: 2756 - DNA, 1850 bp, artificial
  synthetic oligo
aataaatgcttgtgttctcacttttagatttgacttcactccagaaaaaaggcatgtagtcacttgctagcttctatacttaataataatcaataaaaattattatcatgctttaattcatatgatatttcagagactactgtgttttctaggaactagtaaattttgaaattttcacagcatccatagttcatgattatcaatatataactaagtccactaaggagaagcaagattatttgattttccccagatagtaatatagaaatgatggtgatgatgatgatgatggtggtggaggaagaatataacatttacttattaaaattttaccatcttaccttggaccaagtatatgtattatttcattaaattctcacatgtccctgtgaggtataggacctattactgtaactatctcatagatcaaaaaattgaggtaaaaaagaggttaagtaacttgcctaaggttatataactactattttgctcatgcagagctcaggttaagatcccaggcagtctgactcccaaggtctgtacaactcccttagctactgctaatgattggctaaattaggacttgagaaaaaattcttaactgtaacactaatactctttccattctacaattcagaaggctccttgcaccaccaaataagttcggagtcaatgcttaaaaaggatgatggtcaaaggcattgtgtctttgtggagagaggtaggtttctggagcctgcagccagtaaaatctgcttatagccctgagcactcagaactaaactattccaccaagggaaaagcagtaacacagcagctaagtgtgtttgaaggaaaatttgaaggtggccctcctagtctgtattgccacttggtaagcacaaagtggaggaggaggatggagttagcacatcccctttacaaattggtttctctatgtctcatctcataatctcttgaacgactgtttccatagacacccacacttcagtttcccagcttaaccacatttgaacaagaatgcaggctttggcttcagcagctgtgaactgttttaccatgtgtctaacaggcatggcttatctaccttcctgtctgtgtgcaacagaacagaggggtgggagcagttcaaccaacagtaatgcaacagtaatgcaacattaggagtttcaaagctaaacaaacccaatttgatccatatgaaacaaggcaaaagcagacaaaaaaggagtgactttttttcattcttggcttttgggagtgggagtggggcaatagtggcttgaagttggctgtttcacaagtgtaaaatgaaagcacaagccttttttttttctttctgaaacagagctgtgggtccctggggactcagaggggaaggcgatagagtgtgggagtctatgtgggcactgaaagaaacctagaacataagttaatgaaattcacagcccacaaagctgtgctttaattttgaacttgaactagcaacagttaaataaaataattgaatcaaattaggtttaaaataacttgcctgctgagaatataggaaactaacaatgtagtagaagtttccatacaaaggaaaaagaaaaataataatcttaaaaatttactcttgtgaaaaaaaaatgcacttgtcaattggcctaggaatttcaggtagagccatgacaaaaaagtatgaacacacacacacacacacacacacacacacataaaaacacatataatcatttatgagggatttgtgtacatccactacacaaaccatgcaaatttctacacatcccacttgaacacagcatgtatacaactgttcctcatattagggattgttttgaagttca

SEQ ID NO: 2757 - DNA, 1000 bp, artificial
  synthetic oligo
ccacaggtataaacaaatccatttacacttctctttataaattatatagtttgacattttatagttaaatatttgttcagtcctctggaatttattttggtttcaggagtgagtgggggatacagccttatttttttgaaaatataagccagtgtcttggcggcatagaacttaccatcttcaggtaacgaagttgaggctagagcagttaaacaactcacctaaagtttctaagtgagttattagcaaagtagagactagaaatctggtctcctacttaaacttttggcctgtaatttttccaacaaagtacgctgactcattgtcaccttctctacttaattaagtactttcctggcttgacagcattctgatttactctaacccagtagaaattagatgaaaaaactttttaaatttaaacaattatctccttgccaccaggaaagtatgaattagaaaatgatttatttccttgtatagggaagatttataccaggaactttggagagagagaccaggtgtgctttaaactggtggttggcataagtctggaaggtaatgatcataatgctatcatgagagagggttggagtaagaatggtaacaaagtaagaggggagaactggacttctttatatttttctcttaggctagacctcacagaattactagttgtatgtaattagtaagatatgctttaaattaataataacagcttgcacttatcaggatcttaccatgtataaagtactttgttaggcttcatatgaattatctctggtcctcagtatacagatgataaagctagtaattgttgagtaagaattcaaactcagaacagtttgattccagagcctctgctctcttaattaaacttcagttctttcaacctttatttcttttcagtaattctgcttttgaatcttagatcagaaatctattattataagaaaactcagcatataaaattttgctaatgtaattaatcaaatagaga

SEQ ID NO: 2758 - DNA, 1150 bp, artificial
  synthetic oligo
atggaaattaagaatatacctttaaatacttaaatagcagaagatagataatgaaaaaagttttaactgaatggtaataaagttaacaaatatcagaacttgtgaaatgcagctgatgcagaacatgataaaaataaagagccttacaattttatgttagaaaaaatatggagattaattagctaataatatttcctaagaaaataagttattgatattaaaataaacccaaatatatagaaaggaaaataagataaatgcagaaattaatgaaaaaacaatgttacaatagggaaaaacaatgaaggtaaaaattagtttgctctaaggtaaataataaacacacttctcacaaatgagcaagaataaaagaaaataagaacagttaaccagcatctggaataaagcagtggcaaaatcacaatttctgcagtaattataaagataagagattataactgataaatgtatgacacaccagattgaaaatctagttgaacatatttctagaagcagacattaccaaaactacccaaaagaggaacagaaagactgaatttttctataactgattgaaaattgaattcataagcaaaagctatccactacggaaatggaaattcataaccaggttacttcactgctgaattctactgaacattcaaagaggaagaaactttaatcgtacataagttctcccaaagaatagagaaagcagaaatgtttcacaattcattttatgaggctcacatattcttaatatcaaaaccacacaaagcagacggtgacatcaaaaagatagcagaataggaagtcccacagaagcaacaattgaacaattatatatagaccaaaatacttttatgatatttccaaactccagataggaatttgctgtaccccaggtaagcatagagctgagaacaggcacattgaaatgggaaagaagagcaattaagatttaccaacattaggcacttcccaagacagcacaggttgttccagagaaaaaaatgtctcagctcgttatttctccctagaggaagggagagggagaaaaaagtggaaaatgtatacaaatttttggcttttctgcagccttcctgaaagaatgacttttcatttcactcagagtgctgatgggcttggc

SEQ ID NO: 2759 - DNA, 1850 bp, artificial
  synthetic oligo
gacgtataccttatattagtcagtgtcgtgaaataccgacgtatatattaaatttgtaggtgtcataaaataacgtcatatatattatatttgtaggtgtcgtaaaataccgacgtatataatataggtgtcgtgaaataccgacgtatgtattatattcgtaggtgtcatgaaattccgtcgtatatgttatattcgtcggtgtcgtaaaataccgacgtatatgttatattcgtcggtgtcgtaaaataccgatatatatcttagattcgtcggtgtcataaaataaggacgtatatgttacattcgtcagtgtcataaaataacgacgtatatgttacattcgtcgttgtcatgaaataccgacgtataccttatattagtcggtgtcgtgaaataccggcgtatatattatattcataggtgtcgtaaaataacgacatatatattatatttgtaggtgtcgtaaaatactggcgtatatattatagtcttccgtgtcgtaaaataccgacgtatttgttataatcgtcggcgtcgtaaaataccgacgtatatgttatgttcatcggtgtcataaaatagcaacatatatattacatttgtaggtgtcgtaaaataccgacatatatagcataggtgtcgtgaaataccgacgtatatattatattcgtaggtgtcgtgaaataccgacgtatatattatattcataggtgtcgtaaaataacgacatatatattatatttgtaggtgtcgtaaaatacagacgtatagagtataggtgtcgtgaaataccgacgtatatattatatttgtaggtgtcgtgaaataccaacgtatatcttatattcgtaggtgtcgtgaaattccgtcgtatatgttatattcgtcggtgtcgtaaaataccgacgtatatgttatattcgtcggtgtcgtaaaataaggacgtatatgttacattcgttgctgtcataaaataccgacgtatatgttacattcgtcgttgtcgtgaaataccgacgtataccttatattagtcggtgtcgtgaaataccgacgtatatattatattcgtaggtgtcataaaataacgtcatatatattatatttgtaggtgtcgtaaaataccgacgtatatagtataggtgtcgtgaaataccgacgtatatattatattcctggtgtcgtaaaataacgacatatataatatatttctacgtgtcgtaaaataccgacgtatatagtataggtgtcatgaaataccgaaatatgtattatattcgtaggtgtgaaattccctcgtatatgttgtattcgtcggtgtcgtaaaataccgacgtatatgttttattcgtcggtgtcgtaaaataccaacagatatcttagattcgtcggtgtcataaaataaggacgtatatgttacattcgtcggtgtcgtaaaataccgacgtatatgttacattcgtcgttgtcgtgaaataccgacgtataccttatattagtcggtgtcgtgaaataccggcgtatatattatattcgtaggtgtcgtaaaataacgacatatatattatatttgtaggtgtcgtaaaataccgacgtatatagtataggtgtcgtgaaataccgacgcatatattatattcgtaggtgtcgtgaaataccaacgtatatcttatattcataggtgtcgtgaaattccgtcgtatatgttatattcgtaggtgccgtaaaataccgacgtatctgttatattcttccgtgtcgtaaaataccgacgtatctgttataatcgccggtgtcgtaaaataccgacgtatatattatagtcttccgtgtcgtaaaataacgac

SEQ ID NO: 2760 - DNA, 1500 bp, artificial
  synthetic oligo
ggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggag

SEQ ID NO: 2761 - DNA, 1200 bp, artificial
  synthetic oligo
gagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggaga

SEQ ID NO: 2762 - DNA, 1300 bp, artificial
  synthetic oligo
attcataagggtggaaccctcatgacttaatcacctcttaaaggctccaccttttaatactatcacattgggtcttaggtccccaacatataaatttgtggggaacaccaacatttaggccatagcaagtggtatatacagtgtgccatgggagcacggaggagagagcaacagagaagaaagcctccatgggtaacacatgccatcagaagtgccctcagactatatgatctaagggggatagacctagggaaaatatttggtttgggggaagagtttgcttctctctagctgtgattttggattttgcaagttacatataaatgtcaggggagagagaaagacagaacgtaagccatgcttaataaaatcaagcaacttctctacagccacaaatccagctggatttgggttggctcttccgtaaagtttggaagatgagttacattctgtacaagtgctagaaaaatcaatatccgaaggggtagctaattaaaccacagagacttattttttgagccagtaaaggttttctccagtggtcagatgttcatgaatttcaaattctttttgcagactttgcataaagatgagtcctgagacaagtcaaccctagcttggatagcctctgaaaactggctctactccccttgtcaaggataggaaaggcagactgagctctttcctgcagcagcctgtaggtggagaccttcaccttcctgagcaggtcagtcccactctctgtcagccctatgaatagagaatacaccataaaacttccacacttggtggggagcagagagagctttcctttcaccatttatggactttaaggatgtggattttatgcttgttttcttcctctcctgattgcttgacactgtgccttttctccaaaagaagctgaaaagttactgggtcacctttctcccttccaggagctgctggaccctgagtcccttcctgtctctcaccaactaactgtgtgccatccctagaggcctgaccccattcagtgcccaaaagaggaagaaggtcacaagaagaaacgagaaatcttgggtcgctcagaaacactgtctctactctgagaacgatgtttctgtgtcttctcttcctggataagagggcctgaaggactctaaggccagagtctttctgtccaccacaggccttaagccaacaatgtacacattgtgttgctgtgcaaacagggattacttttatctcttccccccaaagtttcctctgctgtgctttggaaaagtaaatcaataaggcatgagaagatagagaatta

SEQ ID NO: 2763 - DNA, 2300 bp, artificial
  synthetic oligo
tgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactgatcaataaaagtaaactggcgcctccacggcttgattgagcgggagcaaagagtctgagaagtagtctcggccattaacaatcccccaggtaacgagaaatggaagaattactcaggtaaaatgattaacattgtcgtagcatctgaaaagatgcacacaacaagataagaagactgcagacctcttaccttagggagtgctaatagaatgtctatattctgctgtcttttaaagataaataggagaattcaattcatgtacaatgtcattaccttcataattgcaatcacaatgtaaagacatgttctgcatttgcaaagacaaaccctctttgctaaggcgatgccaccgtgttccctgcttcctgctcgctgttcacactccaggcacccctcttttccaaggagagcatccaagtacttccagctaccaaaccacttttacacaagccaggtgctaagggaggcaggggcgtgtgcctatgctttccttctttcctattatctcctccccacccctaatctcaaagtgacagttacacagccttccccatccccacacacaaaatagctcttccatcccccagtctatttctacagataatcctaacaacagcctttgccctcagaatttctttttttctaataggcacactcgatcattatactccaagaatgccattgactaaatgagtagcccaaaacactttcatgatcaggaatttattaactaactgaataaaatcgttctgcatgtagataataaaaacaagaaagttctctccgttttagcttccctttacttcaatcctgaagggagccccgcctcctcagcctctttagagacacaagagggacatctagtgaccatcctcagtattttttaatccaacagctactaagaaatactaatactaatggtgctatgccgcctacggctgctctccaggtcaaagcagctccactgaggccagaatcaaaattggcaaagagaattttt

SEQ ID NO: 2764 - DNA, 1100 bp, artificial
  synthetic oligo
gacccattttccccagtttccataagccatgtcatccctgattaaagagccaggtaggtcaatgtcaaataagtacttactcttccatttgctagatgttataggaggaatatttaaaaatttttaagtgttcagaatgctactaaacttttaggtattggagaggggtaggaatataagcaagctgctatgaccaacacacaactaaagtgcatgtcccaagaataaaaggttaggcctgatgatcatgtactttaattcctcaaggtaaggtcggcataatctaagagcaaaaaaccaaatacaagcccttggggtcagccacacttgaaaaggaggaggaaattcaaacaacaaagtaaactagaaagagcagtaaaagggaagaaaatcaggatgttacacagtcaaaacaaaaaaagaaaaatatttttagtggtaccaaatgcaacaaagacttcaagaaagagaagcagcaaaaagcgatttgaccaggaggaagttagctgtggtttccgaggttaagtggtttctgactgggcaggtggtttctattatataaatggtggcttacatagaatgagatgttgagatcatcttatttcacacagaacattaaaggaccattataattagactcactcattcattcatttattccattagcatttactgtgttcttacaagtgcctgatgctactaagctccatggggtcagggtacctaatagaaaaaccataattaaatcataatggcttctctctcacaagcaatccgggtgaagttttaaagcgatgacttaaaaatgaaagtcttatttccctatagctgtttcagtttatatattcatttctgacacattagccttttgttttcctttttaaattagtaaggtttggtttgccgcatcacaaagtttcaacctagaaaagtagcaaacttaaaaaaaaatcaaatctcaaattatcttatatatgctgtgaggaaaagtagaaatggcattaatatcttaggttaatttttttccctgcaaacacaaacaaaaaccctcacagaatagtccaaaggaaccaaagtttactgtttcatgagaaaatgca

SEQ ID NO: 2765 - DNA, 1200 bp, artificial
  synthetic oligo
gggcaaggcacttaacttctcagtctctttttcatcataatatggttataactgtagcacctactgtatagagttattgtgaggattgcatttttatgtaaagaacttatcacagtgtccagctcaatggagcctaacaaccagagcctaacaagctcagagagccagaatgctacatatactcacagatcaattaccccagaacaggcctccagctccatttcactgctctgaccaagagtgagacacctgaaattgtgttaccagaaatgttcatcctctgcccaaaaagggcctcacaagccaagttggtggtgcttttctactagggtgctaaaaaccaaacaaccaaaaacgcagaaaacttcatcaaggccacgtctctgcattaaacattgttcccacagcgacaaaagtcttaagtcattaatacctcaatattaatagatttatgagaggtgggggtggggagcttaaagagcagaaaataagccagttaaatataggaggtccaggatgtacagaagactcatttttgccacaaatatacaaggtctagggtcaaccctgccaagcacagtactctggaattttacgtcctctaatcctgaagaagcagggtactgggggaagaaaagcttgattagaaagtcaccacttttcaagccaccagaattctaaccaaatgatttcaccaccccaaatcccacctcattcaatgttaagggttggaggaacacctttttctgccccattacaaaccaacacaggagacagaagcattctgtgccccttctgagatctcggggaccctcctccagtaccagatctctcacagcctgcttgaagagcggcaatataaagcagctccacagcacacagccaggtccccagccccaagcgcagagggagcccactgaggcaggactccagccaaccagcctccagcctttacctgtggctgactggccaacgccagagaagccgcgatgtcgtaggtccgaagagagtgcgggttagcgaccccgctcgacggccgagcgctgtgagaggaacccacgaaaaggtgactggacgccttggagggcgcagttcccgctaggagctcggccccgcccccgcccccagggccagctctcgggaggggcaccagctcgggctggcgggaaaagcccgggcactccccgcgaggggagccga

SEQ ID NO: 2766 - DNA, 1050 bp, artificial
  synthetic oligo
ccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaactaaaaaaaaatctgagattaaatacactagagtgttaattggtgaacatttctgtgtgttaactaatcccagcactttgggaggctaaggtaggca

SEQ ID NO: 2767 - DNA, 1000 bp, artificial
  synthetic oligo
actgaggcgctcttacctttgcgtcctgatctccaagcaagcacactgaccttcttcaggcaaatacgcactgttaattttccagaaagttctgtgagtaaggtttatacctctcgagtctgccactagatgccgccaaatcccagcaaaggattggctgtttggtccctgggattctgggattttgtttccctcccccctcccctttctgatttgctgaacggtaatatctataggcatcatggatatcgttcattcctaggaaaaaataaaatcaacttctgtaaatagcactagtaggcaggggactgtgacccaagatccaaataattttgctcatttctttccttttctccttgggttaaaaaaaaaaaaaggcccctctccatccctcttttcttttgtccttgccttgtttaatcaaagagttaatgaatgacgcaagcactgatgctgaagatcctaaccctttttcctcaccttttcaaatgctcgcaactcacccaaactgaaaatacagatagctgttccgtcagtaaagatagataagaactcatcagtaaaacctggaccctggtattgaaaactgattttccttttctcttgaaatttgtatcagatatgtgtttttgcaccctattttctgtagtggtattggtaaactttattgtgtctttggagtaagagaaagagacctaattgtaaacctcattccaccacttactagtctcagtaccctgggcaaatgatttatgttttgtgatcctcagtttttttgtatgctttctatattttagatgctgtgttatatcgttcacgttgatttttttattcatcaccaagtccttattagatgagcactactggatcaaagtcaaacaacaaaaatcatacccctttcaattatctatcttatatacttgtacaccacacaggagggatttttttagagcagtggttcccaaggtgtgtttcctggatgtaccagaaacatcagcgt

SEQ ID NO: 2768 - DNA, 1150 bp, artificial
  synthetic oligo
aatgggcattgtttctcaattaggattgaaattaatcttcaatttattttttcttagatttatttttattgatatgtaacatacactatagatattaattgtaatgaatcagttattcacatacactcatgcatacatgcatgtgtacatgtgtgtgtaaccatcactcatatcaagatattgaacattcccaatgcttccaataatttctctccaacttctttccatttaatacttacccttgtattgaggtaatcactattctgacttttaacaccattgattgatcttcagtttaagtattggttttaggtagaaaaatagtttattatatagagaatatacatagaaaaagacacatcaaaatgttaaaagtgattatctacatagatctaggaatacacatgattttacttctgctttatagtcatcttacttgtaatgtggacatattaacaataaaataataaaagcctctctccttaaaaaataccttttataaactctgcatggaatgtttggatgtcattcatccaaaactttcgccaacgtttctttatcctattatttcagctgattttttttccctttgactcctctactgtgatctaatcacagctatcagagtagaaagggcaggatagggagaaaaggagttctctgacttggatacttgagattaggctttcaatgctgtatgtttcagagggaacatgatttttccccaagcatcaatgaaactaaaactgtttgatatttggactatagttctactgcacttgattatttaaaatgttttaccaaattgagaagatacaaacagcatttatttttctactaggctaaggacaatttaaaaccacttaaacttcctttgcttatgaaccatacaaaccactaagtggagctgtaggctcaagtatgagaaatgtgtgcatgagttcaattattttgtggaaacagatataatgaggttctgagagttcaccaagaataatgaaaaattccagcttcatttttctcctaaaattttacctccttgtttaaagaagtattcagaacctgggattttgaagggttgggtgtggtcatttagaaggggtgggatacatagaagccattcagtttcattatttcatttcataccatg
